United States Patent 12,508,308 (INFLUENZA mRNA VACCINES) - sequence listing, part 54

SEQ ID NO: 211493 - RNA, 1758 nt, Artificial Sequence
  derived and/or modified sequence opt5 from hemagglutinin__InfluenzaB__ALN39730
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacgugcgccucucuacgcauaacgucaucaaugccgaggacgcuccgggcggccccuauaagauugggacaagcggauccugcccuaacaucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcaaaagagcgggaaaacaggaaccauuaccuaccagcggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaccucaagagcacccaggaggcuaucaauaaaauuacaaagaaccuuaauucccuuagcgaacuggaggugaaaaaccuccagcgccugucuggagccauggaugagcugcauaaugaaauccucgagcuggacgaaaaggucgacgaucuuagagccgacaccauuuccagccaaaucgagcuggcugugcuccugucuaacgaaggcaucauuaauagcgaggaugagcaccuucuggcccucgaacggaaacugaagaagaugcuggggcccuccgcggucgagaucggcaacggauguuucgaaacaaaacauaagugcaaucagaccugccucgaccgcauugcugccggcacguuugaugccggggaguucuuucugccuaccuucgacucucuuaacaucacagcugccagccugaaugaugacggacucgauaaccacaccauucugcuguauuacuccacagcugccagcucucuugcggugacccucaugaucgccauuuucguuguguauauggucuccagagacaaugugagcuguucuaucugccuguga

SEQ ID NO: 211494 - RNA, 1755 nt, Artificial Sequence; identical to SEQ ID NO: 211313
  derived and/or modified sequence opt5 from hemagglutinin__InfluenzaB__ALN39732

SEQ ID NO: 211495 - RNA, 1755 nt, Artificial Sequence
  derived and/or modified sequence opt5 from hemagglutinin__InfluenzaB__ALN39733
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacagaugcaaccaaacaugccucgaccggaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccguuacacucaugcuggcuauuuucaucguguauauggucucuagagacaauguguccuguagcauuugccuguga

SEQ ID NO: 211496 - RNA, 1755 nt, Artificial Sequence
  derived and/or modified sequence opt5 from hemagglutinin__InfluenzaB__ALN39751
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugguugccggauggcacggcuacacaagccauggggcucacggaguggcggucgccgcugaccucaaguccacgcaagaggccauuaacaagaucaccaaaaaucugaacagccuuucugaacuggaggugaagaaucuccagagacuguccggcgccauggaugaacugcauaacgagauccucgagcuggacgaaaaagucgaugaccuucgggcugauacaauuagcucucagaucgagcuggccgugcuccugagcaaugaagggauuaucaacuccgaggacgaacaccuucuggcgcucgagcgcaagcugaaaaagaugcugggaccuucugcuguugauauuggcaauggguguuucgagaccaagcacaaaugcaaccaaacaugccucgacagaaucgccgccggcaccuuuaaugcuggagaguucagccugcccacguuugauucccuuaacaucaccgccgcuagccugaaugacgauggccucgacaaccauacaauucugcuguauuacucuaccgccgcguccagccuugccgugacacucaugcuggcucuguucaucgucuauauggugucucgggacaauguuuccuguagcauuugccucuga

SEQ ID NO: 211497 - RNA, 1755 nt, Artificial Sequence; identical to SEQ ID NO: 211472
  derived and/or modified sequence opt5 from hemagglutinin__InfluenzaB__ALN39752

SEQ ID NO: 211498 - RNA, 1755 nt, Artificial Sequence; identical to SEQ ID NO: 211313
  derived and/or modified sequence opt5 from hemagglutinin__InfluenzaB__ALN39753

SEQ ID NO: 211499 - RNA, 1758 nt, Artificial Sequence
  derived and/or modified sequence opt5 from hemagglutinin__InfluenzaB__ALN39754
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacgugcgccucucuacgcauaacgucaucaaugccgaggacgcuccgggcggccccuauaagauugggacaagcggauccugcccuaacaucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcaaaagagcgggaaaacaggaaccauuaccuaccagcggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaccucaagagcacccaggaggcuaucaauaaaauuacaaagaaccuuaauucccuuagcgaacuggaggugaaaaaccuccagcgccugucuggagccauggaugagcugcauaaugaaauccucgagcuggacgaaaaggucgacgaucuuagagccgacaccauuuccagccaaaucgagcuggcugugcuccugucuaacgaaggcaucauuaauagcgaggaugagcaccuucuggcccucgaacggaaacugaagaagaugcuggggcccuccgcggucgagaucggcaacggauguuucgaaacaaaacauaagugcaaucagaccugccucgaccgcauugcugccggcacguuugaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagcagagacaaugugucuuguuccaucugccuguga

SEQ ID NO: 211500 - RNA, 1758 nt, Artificial Sequence
  derived and/or modified sequence opt5 from hemagglutinin__InfluenzaB__ALN39755
augaaggccaucauugugcugcuccuggucguuaccagcaacgcugacagaaucugcacaggcauuacguccucuaauagcccccacguggugaaaaccgccacacagggggaggucaacgugaccggaguuaucccucuuacaaccacaccgaccaagucccauuucgcgaaucugaaaggcacggaaacccgggggaagcucugucccaaaugccugaacuguacagaucuugacguggcucugggacgcccuaagugcaccggcaagauucccucugccagagucagcauccuccacgaggugcggccuguuacauccggguguuuucccaucaugcaugaucgcaccaaaauuagacaacugccuaaucugcuccggggauacgaacacgugcgccugucuacgcauaacgucaucaaugccgaggacgcuccgggcggccccuauaagauugggacaagcggauccugcccuaacaucaccaauggcaacggguucuuugccacaauggcuugggccgugcccaaaaaugauaagaacaaaaccgcgaccaauccucuuacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacucccccaguccggcagaaucguggucgacuauauggugcaaaagagcgggaaaacaggaaccauuaccuaccagcggggcauccugcuuccucagaagguuuggugcgccucugggcgcuccaaagugauuaagggaagccugccccucaucggcgaagcugauugucugcaugagaaauauggcgggcugaacaaguccaagcccuacuacacaggagagcacgccaaagcgauuggcaauugcccuaucugggucaagaccccgcucaaacuggccaacgggacaaaguauagacccccugcuaaacuucugaaggaacggggauuuuucggcgccaucgcuggguuucucgagggcggaugggaaggcaugauugccggguggcauggauacacgucucacggcgcccacgggguggcuguugcggccgaccugaaaagcacccaggaggcuaucaauaagauuacaaagaaccuuaauucccugagcgaacucgaggugaaaaaccugcagcgccugucuggagccauggaugagcuccauaaugaaauccuggagcuugacgaaaaggucgacgaucugagagccgacaccauuuccagccaaaucgagcucgcugugcugcuuucuaacgaaggcaucauuaauagcgaggaugagcaucugcucgcccuggaacggaaacugaagaagaugcucgggcccuccgcggucgagaucggcaacggauguuucgaaacaaaacacaagugcaaucagaccugccuggaccgcauugcugccggcacguuugaugccggggaguucucucuuccuaccuuugacagccugaacaucacagcugccucccucaaugaugacggacuggauaaccacaccauucugcuuuauuacagcacagcugccucuucccucgcggugacccugaugaucgccauuuucguuguguauauggucagcagagacaaugugucuuguuccaucugccuguga

SEQ ID NO: 211501 - RNA, 1755 nt, Artificial Sequence
  derived and/or modified sequence opt5 from hemagglutinin__InfluenzaB__ALN39756
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacaaaugcaaccaaacaugccucgacagaaucgccgccggcaccuuuaauguuggagaguucagccugcccacguuugauucccuuaacauuaccgcugccagccugaaugacgauggccucgacaaccauacaauccugcuguauuacucuaccgcugccuccagccuugcggugacacucaugcuggccauuuucaucgucuauauggugucucgggacaauguuuccuguagcauuugccuguga

SEQ ID NO: 211502 - RNA, 1758 nt, Artificial Sequence; identical to SEQ ID NO: 211499
  derived and/or modified sequence opt5 from hemagglutinin__InfluenzaB__ALN39757

SEQ ID NO: 211503 - RNA, 1755 nt, Artificial Sequence; identical to SEQ ID NO: 211313
  derived and/or modified sequence opt5 from hemagglutinin__InfluenzaB__ALN39758

SEQ ID NO: 211504 - RNA, 1755 nt, Artificial Sequence
  derived and/or modified sequence opt5 from hemagglutinin__InfluenzaB__ALN39759
augaagaccaucauugugcugcucauggucguuacaagcaacgccgacagaaucugcacgggcauuaccuccucuaauagcccccacguggugaaaacagcuacccagggggaagucaacgugacaggaguuaucccucugaccacaaccccgacgaaguccuacuucgccaaucuuaaaggcacccggacacgcgggaagcugugucccgauugccucaacuguaccgaccuggauguggcgcuuggaagaccuaugugcgucggcacaacccccucugcuaaagccagcauucugcaugaagugcggccuguuacguccggguguuuucccaucaugcacgaccgcacaaagaucagacaacucccuaaucugcugcggggauaugagaagauucgccucucuacccagaacgugaucgaugccgaaaaagcuccgggcggccccuacagacuggggacaagcggauccugcccuaaugccaccagcaagauuggcuucuuugcuaccauggccugggcgguccccaaagacaacuauaagaaugccacaaacccucagacgguggaggugcccuacaucuguaccgaaggggaggaucagauuacagucuggggauuccauucugacaauaaaacccaaaugaagucccuuuauggcgauagcaacccgcagaaguuuacaucuuccgcuaaugggguuaccacgcacuacgugagccagaucggagacuucccugaucagacagaggacggcggccugccccaaucugggcggauuguggucgauuauaugaugcagaaaccuggaaagaccggcaccaucguguaccagcgcgggguucuccugccccagaaaguguggugcgccuccggaagaagcaaggucaucaaaggcucccuuccccugauuggggaagcugacugucuccaugaggaauacggaggccugaacaagucuaaaccuuauuacacaggcaagcacgccaaggcgaucgggaauugcccgauuugggugaaaacaccccugaagcucgccaacggaacaaaauaucggccucccgcuaagcugcuuaaagagcgcggcuuuuucggggccaucgcuggauuucuggagggcgggugggaaggcaugauugccggauggcacggcuacacgagccauggggcccacggaguugcuguggcggccgaccucaaguccacccaagaggcuaucaacaagaucaccaaaaaucugaacagccuuucugaacuggaggucaagaaucuccagagacuguccggcgccauggaugaacugcauaacgagauucucgagcuggacgaaaaaguggaugaccuucgggccgauaccaucagcucucagauugagcuggcuguccuccugagcaaugaagggaucauuaacuccgaggacgaacaccuucuggcccucgagcgcaagcugaaaaagaugcugggaccuucugcgguggauaucggcaauggguguuucgagacaaagcacaaaugcaaccaaaccugccucgacagaaucgcugccggcacguuuaaugccggagaguucagccugcccaccuuugauucccuuaacauuacagcugccagccugaaugacgauggccucgacaaccauaccauccugcuguauuacucuacagcugccuccagccuugcgguuacccucaugcuggccauuuucaucguguauauggucucucgggacaauguguccuguagcauuugccuguga

SEQ ID NO: 211505 - RNA, 1758 nt, Artificial Sequence; identical to SEQ ID NO: 211463
  derived and/or modified sequence opt5 from hemagglutinin__InfluenzaB__ALN39760

SEQ ID NO: 211506 - RNA, 1755 nt, Artificial Sequence; identical to SEQ ID NO: 211313
  derived and/or modified sequence opt5 from hemagglutinin__InfluenzaB__ALN39761

SEQ ID NO: 211507 - RNA, 1755 nt, Artificial Sequence; identical to SEQ ID NO: 211313
  derived and/or modified sequence opt5 from hemagglutinin__InfluenzaB__ALN39762

SEQ ID NO: 211508 - RNA, 1755 nt, Artificial Sequence; identical to SEQ ID NO: 211313
  derived and/or modified sequence opt5 from hemagglutinin__InfluenzaB__ALN39763

SEQ ID NO: 211509 - RNA, 1758 nt, Artificial Sequence; identical to SEQ ID NO: 211499
  derived and/or modified sequence opt5 from hemagglutinin__InfluenzaB__ALN39764

SEQ ID NO: 211510 - RNA, 1755 nt, Artificial Sequence
  derived and/or modified sequence opt5 from hemagglutinin__InfluenzaB__ALN39765
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaauaaccuccagagacuguccggcgccauggaugaacugcauaaugagauucucgagcuggacgaaaagguggaugaccuucgggcugauacaaucagcucucagauugagcuggccguccuccugagcaacgaagggaucauuaauuccgaggacgaacaccuucuggcgcucgagcgcaaacugaagaaaaugcugggaccuucugcuguggauaucggcaacggguguuucgagaccaagcacaagugcaaucaaacaugccucgacagaaucgccgccggcaccuuuaacgcuggagaguucagccugcccacguuugauucccuuaauauuaccgccgcuagccugaacgacgauggccucgacaaucauacaauccugcuguauuacucuaccgccgcguccagccuugccguuacacucaugcuggcucuguucauuguguauauggucucucgggacaacguguccuguagcaucugccucuga

SEQ ID NO: 211511 - RNA, 1755 nt, Artificial Sequence; identical to SEQ ID NO: 211476
  derived and/or modified sequence opt5 from hemagglutinin__InfluenzaB__ALN39766

SEQ ID NO: 211512 - RNA, 1755 nt, Artificial Sequence; identical to SEQ ID NO: 211313
  derived and/or modified sequence opt5 from hemagglutinin__InfluenzaB__ALN39767

SEQ ID NO: 211513 - RNA, 1755 nt, Artificial Sequence; identical to SEQ ID NO: 211476
  derived and/or modified sequence opt5 from hemagglutinin__InfluenzaB__ALN39768

SEQ ID NO: 211514 - RNA, 1755 nt, Artificial Sequence
  derived and/or modified sequence opt5 from hemagglutinin__InfluenzaB__ALN39769
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacggacgcacgaagaucagacaacucccuaaucugcugcggggcuaugagaagauucgccucucuacacagaacgugaucgacgcugaaaaagccccgggcgggcccuacagacugggaaccagcggcuccugcccuaaugcuacaagcaagauuggguucuuugccaccauggcgugggccguccccaaagauaacuauaagaaugcuaccaacccucagacaguggaggugcccuacaucuguacggaaggagaggaccagauuaccgucuggggcuuccauucugauaauaaaacacaaaugaagucccuuuauggggacagcaacccgcagaaguuuaccucuuccgccaauggaguuacaacccacuacgugagccagaucggcgauuucccugaccagacggaggauggcgggcugccccaaucuggacggauuguggucgacuauaugaugcagaaaccuggcaagacagggaccaucguguaccagcgcggaguucuccugccccagaaaguguggugcgcuuccggcagaagcaaggucaucaaagggucccuuccccugauuggagaagccgauugucuccaugaggaauacggcggccugaacaagucuaaaccuuauuacaccgggaagcacgcgaaggccaucggaaauugcccgauuugggugaaaacaccccugaagcucgcuaacggcaccaaauaucggccucccgccaagcugcuuaaagagcgcggguuuuucggagcuaucgccggcuuucuggaagggggcugggaaggaaugauugccggcuggcacggguacacaagccauggagcucacggcguugcgguggccgcugaccucaaguccacgcaagaggccaucaacaagaucaccaaaaaucugaacagccuuucugaacuggaggucaagaaucuccagagacuguccggggccauggacgaacugcauaacgagauucucgagcuggaugaaaaaguggacgaucuucgggcugacacaaucagcucucagauugagcuggccguccuccugagcaaugaaggaaucauuaacuccgaggaugaacaccuucuggcgcucgagcgcaagcugaaaaagaugcugggcccuucugcuguggacaucgggaauggcuguuucgagaccaagcacaaaugcaaccaaacaugccucgauagaaucgccgccggaaccuuuaaugcuggcgaguucagccugcccacguuugacucccuuaacauuaccgccgcuagccugaaugaugacgggcucgauaaccauacaauccugcuguauuacucuaccgccgcguccagccuugccguuacacucaugcuggcuauuuucaucguguauauggucucucgggacaauguguccuguagcauuugccuguga

SEQ ID NO: 211515 - RNA, 1755 nt, Artificial Sequence; identical to SEQ ID NO: 211472
  derived and/or modified sequence opt5 from hemagglutinin__InfluenzaB__ALN39770

SEQ ID NO: 211516 - RNA, 1755 nt, Artificial Sequence; identical to SEQ ID NO: 211472
  derived and/or modified sequence opt5 from hemagglutinin__InfluenzaB__ALN39771

SEQ ID NO: 211517 - RNA, 1755 nt, Artificial Sequence; identical to SEQ ID NO: 211313
  derived and/or modified sequence opt5 from hemagglutinin__InfluenzaB__ALN39773

SEQ ID NO: 211518 - RNA, 1755 nt, Artificial Sequence; identical to SEQ ID NO: 211313
  derived and/or modified sequence opt5 from hemagglutinin__InfluenzaB__ALN39774

SEQ ID NO: 211519 - RNA, 1758 nt, Artificial Sequence
  derived and/or modified sequence opt5 from hemagglutinin__InfluenzaB__ALN39775
augcaggccaucauugugcugcucauggucguuaccagcaacgcugacagaaucugcacaggcauuacguccucuaauagcccccacguggugaagaccgccacacaaggggaggucaacgugaccggaguuaucccucugacaaccacaccgaccaaaucccauuucgcgaaucuuaagggcacggaaacccgggggaaacugugucccaagugccucaacuguacagaucuggacguggcucuuggacgcccuaaaugcaccggcaagauucccucugccagagucagcauccugcacgaggugcggccuguuacauccggguguuuucccaucaugcaugaucgcaccaagauuagacagcucccuaaucugcugcggggauacgaacacauccgccucucuacgcauaacgugauuaaugccgaggacgcuccgggcggccccuauaaaaucgggacaagcggauccugcccuaacauuaccaauggcaacggguucuuugccacaauggcuugggccguccccaagaaugauaaaaacaagaccgcgaccaauccucugacaaucgaagugcccuacauuuguacggagggagaggaccagaucaccguguggggcuuccacagcgauaacgaaacacagauggccaaacuuuauggggacucuaagccgcaaaaguuuaccuccagcgcuaauggagucacaacccacuacguuucucagaucggcggcuucccuaaccagacggaggaugggggacugccccaguccggcagaauugugaucgacuauauggugcaaaaauccgggaagacaggaaccauuaccuaccagcggggcauccuccugccucagaaagucuggugcgugucugggcgcuccaagguuauuaaaggaagccuuccccugaucggcgaagccgauugucuccaugagaaguauggcgggcugaacaaauccaagcccuacuacacaggagagcacgcuaaggccgugggcaauugcccuaucugggucaaaaccccgcugaagcucgcgaacgggacaaaauauagacccccugccaagcugcuuaaagaacggggauuuuucggcgcuauugccggguuucuggagggcggaugggaaggcaugaucgcuggguggcauggauacacgucucacggcgcccacgggguggccguugcugcggaccucaagagcacccaggaggccauuaauaagaucaccaaaaaccugaauagccuuagcgaacuggaggugaagaaccuccaacgccugucuggagcuauggaugagcugcauaaugaaauucucgagcuggacgaaaaagucgacgaucuuagagccgacacaaucuccagccagaucgagcuggccgugcuccugucuaacgaaggcauuaucaauagcgaggaugagcaccuucuggcucucgaacggaagcugaaaaagaugcuggggcccuccgccgucgagauuggcaacggauguuucgaaacaaagcauaaaugcaaucagaccugccucgaccgcaucgcggcuggcacguuugaugccggggaguucucucugccuaccuuugacagccuuaacauuacagccgcuucccugaaugaugacggacucgauaaccacaccauccugcuguauuacagcacagccgcuucuucccuugccgugacccucaugauugcgaucuucguuguguauauggucagcagagacaaugugucuuguuccaucugccuguga

SEQ ID NO: 211520 - RNA, 1755 nt, Artificial Sequence
  derived and/or modified sequence opt5 from hemagglutinin__InfluenzaB__ALN39776
augaaggccaucauuauccugcucaugguggucaccagcaacgcugacagaauuugcacaggcaucacguccucuaauagcccccacguugugaaaaccgccacacagggggaagugaacgucaccggagugauuccucugacaaccacaccgaccaaguccuacuucgcgaaucuuaaaggcacgcggacccgcgggaagcugugucccgauugccucaacuguacagaccuggauguugcucuuggaagaccuaugugcgugggcaccacacccucugccaaagccagcauccugcaugaaguccggccugugaccuccggguguuuucccaucaugcacgaccgcacgaagauuagacaacucccuaaucugcugcggggauaugagaagauccgccucucuacacagaacguuauugaugcugaaaaagccccgggcggccccuacagacuggggaccagcggauccugcccuaaugcuacaagcaagaucggcuucuuugccaccauggcgugggccgugcccaaagacaacuauaagaaugcuaccaacccucagacagucgaggugcccuacauuuguacggaaggggaggaucagaucaccguguggggauuccauucugacaauaaaacacaaaugaagucccuuuauggcgauagcaacccgcagaaguuuaccucuuccgccaauggggucacaacccacuacguuagccagauuggagacuucccugaucagacggaggacggcggccugccccaaucugggcggaucgugguggauuauaugaugcagaaaccuggaaagacaggcaccaucgucuaccagcgcggggugcuccugccccagaaaguuuggugcgcuuccggaagaagcaaggugauuaaaggcucccuuccccugaucggggaagccgacugucuccaugaggaauacggaggccugaacaagucuaaaccuuauuacaccggcaagcacgcgaaggccauugggaauugcccgaucugggucaaaacaccccugaagcucgcuaacggaaccaaauaucggccucccgccaagcugcuuaaagagcgcggcuuuuucggggcuauugccggauuucuggagggcgggugggaaggcaugaucgccggauggcacggcuacacaagccauggggcucacggaguggcgguugccgcugaccucaaguccacgcaagaggccaucaacaagauuaccaaaaaucugaacagccuuucugaacuggaggugaagaaucuccagagacuguccggcgccauggaugaacugcauaacgagauccucgagcuggacgaaaaagucgaugaccuucgggcugauacaauuagcucucagaucgagcuggccgugcuccugagcaaugaagggauuaucaacuccgaggacgaacaccuucuggcgcucgagcgcaagcugaaaaagaugcugggaccuucugcugucgauaucggcaauggguguuucgagaccaagcacaaaugcaaccaaacaugccucgacagaauugccgccggcaccuuuaaugcuggagaguucagccugcccacguuugauucccuuaacaucaccgccgcuagccugaaugacgauggccucgacaaccauacaauucugcuguauuacucuaccgccgcguccagccuugccgugacacucaugcuggcuaucuucauuguuuauauggugucucgggacaaugucuccuguagcaucugccuguga

SEQ ID NO: 211521 - RNA, 1755 nt, Artificial Sequence; identical to SEQ ID NO: 211476
  derived and/or modified sequence opt5 from hemagglutinin__InfluenzaB__ALN39778

SEQ ID NO: 211522 - RNA, 1758 nt, Artificial Sequence; identical to SEQ ID NO: 211499
  derived and/or modified sequence opt5 from hemagglutinin__InfluenzaB__ALN39779

SEQ ID NO: 211523 - RNA, 1755 nt, Artificial Sequence; identical to SEQ ID NO: 211313
  derived and/or modified sequence opt5 from hemagglutinin__InfluenzaB__ALN39780

SEQ ID NO: 211524 - RNA, 1758 nt, Artificial Sequence; identical to SEQ ID NO: 211499
  derived and/or modified sequence opt5 from hemagglutinin__InfluenzaB__ALN39781

SEQ ID NO: 211525 - RNA, 1758 nt, Artificial Sequence; identical to SEQ ID NO: 211463
  derived and/or modified sequence opt5 from hemagglutinin__InfluenzaB__ALN39782

SEQ ID NO: 211526 - RNA, 1755 nt, Artificial Sequence
  derived and/or modified sequence opt5 from hemagglutinin__InfluenzaB__ALN39783
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaaccuucagacaguggaggugccuuacaucuguacggaaggggaggaucagauuaccgucuggggauuccauucugacaauaaaacacaaaugaagucccuguauggcgauagcaacccccagaaguuuaccucuuccgccaaugggguuacaacccacuacgugagccagaucggagacuucccggaucagacggaggacggcggccucccucaaucugggcggauuguggucgauuauauggugcagaaacccggaaagacaggcaccaucguuuaccagcgcggggugcugcuuccucagaaagucuggugcgcuuccggaagaagcaaggugaucaaaggcucccugccccucauuggggaagccgacugucugcaugaggaauacggaggccugaacaagucuaaacccuauuacaccggcaagcacgcgaaggccaucgggaauugcccuauuuggguuaaaacaccgcucaagcuggcuaacggaaccaaauaucggcccccugccaagcugcugaaagagcgcggcuuuuucggggcuaucgccggauuucucgagggcgggugggaaggcaugauugccggauggcacggcuacacaagccauggggcucacggaguggcggucgccgcugaccugaaguccacgcaagaggccaucaacaagaucaccaaaaaucuuaacagccugucugaacucgaggugaagaaucugcagagacuguccggcgccauggaugaacuccauaacgagauucuggagcuugacgaaaaagucgaugaccugcgggcugauacaaucagcucucagauugagcucgccgugcugcuuagcaaugaagggaucauuaacuccgaggacgaacaccuucucgcgcuggagcgcaagcugaaaaagaugcucggacccucugcuguugauaucggcaauggguguuucgagaccaagcacaaaugcaaccaaacaugccuggacagaaucgccgccggcaccuuuaaugcuggagaguucagccuuccuacguuugauucccugaacauuaccgccgcuagccucaaugacgauggccuggacaaccauacaauccugcuuuauuacucuaccgccgcguccagccucgccgugacacugaugcuggcuauuuucaucgucuauauggugucucgggacaauguuuccuguagcauuugccucuga

SEQ ID NO: 211527 - RNA, 1758 nt, Artificial Sequence; identical to SEQ ID NO: 211475
  derived and/or modified sequence opt5 from hemagglutinin__InfluenzaB__ALN39784

SEQ ID NO: 211528 - RNA, 1758 nt, Artificial Sequence; identical to SEQ ID NO: 211499
  derived and/or modified sequence opt5 from hemagglutinin__InfluenzaB__ALN39785

SEQ ID NO: 211529 - RNA, 1755 nt, Artificial Sequence; identical to SEQ ID NO: 211313
  derived and/or modified sequence opt5 from hemagglutinin__InfluenzaB__ALN39786

SEQ ID NO: 211530 - RNA, 1758 nt, Artificial Sequence; identical to SEQ ID NO: 211499
  derived and/or modified sequence opt5 from hemagglutinin__InfluenzaB__ALN39787

SEQ ID NO: 211531 - RNA, 1758 nt, Artificial Sequence; identical to SEQ ID NO: 211499
  derived and/or modified sequence opt5 from hemagglutinin__InfluenzaB__ALN39788

SEQ ID NO: 211532 - RNA, 1755 nt, Artificial Sequence
  derived and/or modified sequence opt5 from hemagglutinin__InfluenzaB__ALN39790
augaaggccaucauugugcugcucauggucguuaccagcgacgcugauagaaucugcacaggcauuacguccucuaacagcccccacguggugaaaaccgccacacagggggaagucaaugugaccggaguuaucccucugacaaccacaccgaccaaguccuacuucgcgaaccuuaaaggcacgcggacccgcgggaagcugugucccgacugccucaauuguacagaucuggacguggcucuuggaagaccuaugugcgucggcaccacacccucugccaaagccagcauucugcaugaagugcggccuguuaccuccggguguuuucccaucaugcacgaucgcacgaagaucagacaacucccuaaccugcugcggggauaugagaagauucgccucucuacacagaaugugaucgacgcugaaaaagccccgggcggccccuacagacuggggaccagcggauccugcccuaacgcuacaagcaagauuggcuucuuugccaccauggcgugggccguccccaaagauaauuauaagaacgcuaccaauccucagacaguggaggugcccuacaucuguacggaaggggaggaccagauuaccgucuggggauuccauucugauaacaaaacacaaaugaagucccuuuauggcgacagcaauccgcagcgguuuaccucuuccgccaacgggguuacaacccacuacgugagccagaucggagauuucccugaccagacggaggauggcggccugccccaaucugggcgcauuguggucgacuauauggugcagaagccuggaaaaacaggcaccaucguuuaccagagaggggugcuccugccccagaaggucuggugcgcuuccggacggagcaaagugaucaagggcucccuuccccugauuggggaagccgacugucuccaugaggaauacggaggccugaauaaaucuaagccuuauuacaccggcaaacacgcgaaggccaucgggaacugcccgauuuggguuaagacaccccugaaacucgcuaauggaaccaaguaucgcccucccgccaaacugcuuaaggagagaggcuuuuucggggcuaucgccggauuucuggagggcgggugggaaggcaugauugccggauggcacggcuacacaagccauggggcucacggaguggcggucgccgcugaucucaaauccacgcaagaggccaucaacaagaucaccaagaaccugaauagccuuucugaacuggaggugaaaaaccuccagcggcuguccggcgccauggacgaacugcauaaugagauucucgagcuggaugaaaaggucgacgaucuucgcgcugacacaaucagcucucagauugagcuggccgugcuccugagcaacgaagggaucauuaauuccgaggaugaacaccuucuggcgcucgagagaaaacugaagaaaaugcugggaccuucugcuguugacaucggcaacggguguuucgagaccaagcacaagugcaaucaaacaugccucgaucggaucgccgccggcaccuuuaacgcuggagaguucagccugcccacguuugacucccuuaauauuaccgccgcuagccugaacgaugacggccucgacaaucauacaauccugcuguauuacucuaccgccgcguccagccuugccgugacacucaugcuggcuauuuucaucgucuauauggugucuagagauaacguuuccuguagcauuugccuguga

SEQ ID NO: 211533 - RNA, 1755 nt, Artificial Sequence
  derived and/or modified sequence opt5 from hemagglutinin__InfluenzaB__ALN39791
augaaggccaucauugugcugcucauggucguuaugagcaacgcugacagaaucugcaccggcauuacauccucuaauagcccccacguggugaaaacggccacccagggggaagucaacgugacaggaguuaucccucugaccacaaccccgacaaaguccuacuucgcgaaucuuaaaggcacccggacgcgcgggaagcugugucccgauugccucaacuguaccgaccuggauguggcucuuggaagaccuaugugcgucggcacaacccccucugccaaagccagcauucugcaugaagugcggccuguuacauccggguguuuucccaucaugcacgaccgcaccaagaucagacaacucccuaaucugcugcggggauaugagaagauucgccucucuacgcagaacgugaucgaugcugaaaaagccccgggcggccccuacagacuggggacaagcggauccugcccuaaugcuaccagcaagauuggcuucuuugccacaauggcgugggccguccccaaagacaacuauaagaaugcuaccaacccucagaccguggaggugcccuacaucuguacagaaggggaggaucagauuacggucuggggauuccauucugacaauaaaacccaaaugaagucccuuuauggcgauagcaacccgcagaaguuuacaucuuccgccaaugggguuaccacacacuacgugagccagaucggagacuucccugaucagaccgaggacggcggccugccccaaucugggcggauuguggucgauuauauggugcagaaaccuggaaagacgggcacaaucguuuaccagcgcggggugcuccugccccagaaagucuggugcgcuuccggaagaagcaaggugaucaaaggcucccuuccccugauuggggaagccgacugucuccaugaggaauacggaggccugaacaagucuaaaccuuauuacaccggcaagcacgcgaaggccaucgggaauugcccgauuuggguuaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacaccagccauggggcucacggaguggcggucgccgcugaccucaaguccacacaagaggccaucaacaagaucacgaaaaaucugaacagccuuucugaacuggaggugaagaaucuccagagacuguccggcgccauggaugaacugcauaacgagauucucgagcuggacgaaaaagucgaugaccuucgggcugauaccaucagcucucagauugagcuggccgugcuccugagcaaugaagggaucauuaacuccgaggacgaacaccuucuggcgcucgagcgcaagcugaaaaagaugcugggaccuucugcuguugauaucggcaauggguguuucgagacaaagcacaaaugcaaccaaaccugccucgacagaaucgccgccggcacauuuaaugcuggagaguucagccugcccaccuuugauucccuuaacauuacggccgcuagccugaaugacgauggccucgacaaccauaccauccugcuguauuacucuacagccgcguccagccuugccgugacccucaugcuggcuauuuucaucgucuauauggugucucgggacaauguuuccuguagcauuugccuguga

SEQ ID NO: 211534 - RNA, 1758 nt, Artificial Sequence; identical to SEQ ID NO: 211499
  derived and/or modified sequence opt5 from hemagglutinin__InfluenzaB__ALN39792

SEQ ID NO: 211535 - RNA, 1758 nt, Artificial Sequence; identical to SEQ ID NO: 211499
  derived and/or modified sequence opt5 from hemagglutinin__InfluenzaB__ALN39793

SEQ ID NO: 211536 - RNA, 1755 nt, Artificial Sequence
  derived and/or modified sequence opt5 from hemagglutinin__InfluenzaB__ALN39794
augaaggccaucauuauccugcucaugguggucaccagcaacgcugacagaauuugcacaggcaucacguccucuaauagcccccacguugugaaaaccgccacacagggggaagugaacgucaccggagugauuccucugacaaccacaccgaccaaguccuacuucgcgaaucuuaaaggcacgcggacccgcgggaagcugugucccgauugccucaacuguacagaccuggauguugcucuuggaagaccuaugugcgugggcaccacacccucugccaaagccagcauccugcaugaaguccggccugugaccuccggguguuuucccaucaugcacgaccgcacgaagauuagacaacucccuaaucugcugcggggauaugagaagauccgccucucuacacagaacguuauugaugcugaaaaagccccgggcggccccuacagacuggggaccagcggauccugcccuaaugcuacaagcaagaucggcuucuuugccaccauggcgugggccgugcccaaagacaacuauaagaaugcuaccaacccucagacagucgaggugcccuacauuuguacggaaggggaggaucagaucaccguguggggauuccauucugacaauaaaacacaaaugaagucccuuuauggcgauagcaacccgcagaaguuuaccucuuccgccgacggggucacaacccacuacguuagccagauuggagauuucccugaccagacggaggauggcggccugccccaaucugggcggaucgugguggacuauaugaugcagaaaccuggaaagacaggcaccaucgucuaccagcgcggggugcuccugccccagaaaguuuggugcgcuuccggaagaagcaaggugauuaaaggcucccuuccccugaucggggaagccgacugucuccaugaggaauacggaggccugaauaagucuaaaccuuauuacaccggcaagcacgcgaaggccauugggaacugcccgaucugggucaaaacaccccugaagcucgcuaauggaaccaaauaucggccucccgccaagcugcuuaaagagcgcggcuuuuucggggcuauugccggauuucuggagggcgggugggaaggcaugaucgccggauggcacggcuacacaagccauggggcucacggaguggcgguugccgcugaucucaaguccacgcaagaggccaucaacaagauuaccaaaaaccugaauagccuuucugaacuggaggugaagaaccuccagagacuguccggcgccauggacgaacugcauaaugagauccucgagcuggaugaaaaagucgacgaucuucgggcugacacaauuagcucucagaucgagcuggccgugcuccugagcaacgaagggauuaucaauuccgaggaugaacaccuucuggcgcucgagcgcaagcugaaaaagaugcugggaccuucugcugucgacaucggcaacggguguuucgagaccaagcacaaaugcaaucaaacaugccucgauagaauugccgccggcaccuuuaacgcuggagaguucagccugcccacguuugacucccuuaauaucaccgccgcuagccugaacgaugacggccucgacaaucauacaauucugcuguauuacucuaccgccgcguccagccuugccgugacacucaugcuggcuaucuucauuguuuauauggugucucgggauaacgucuccuguagcaucugccuguga

SEQ ID NO: 211537 - RNA, 1755 nt, Artificial Sequence; identical to SEQ ID NO: 211476
  derived and/or modified sequence opt5 from hemagglutinin__InfluenzaB__ALN39795

SEQ ID NO: 211538 - RNA, 1758 nt, Artificial Sequence
  derived and/or modified sequence opt5 from hemagglutinin__InfluenzaB__ALN39796
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgccaccaauggcaacggguucuuugcuacaauggccugggcgguccccaaaaaugauaagaacaaaaccgccaccaauccucugacaauugaagugcccuacaucuguacggagggagaggaccagauuaccguguggggcuuccacagcgauaacgaaacacagauggcuaagcuguauggggacucuaagccgcagaaauuuaccuccagcgccaauggagucacaacccacuacguuucucaaaucggcggcuucccuaaccagacggaggaugggggacugccccaguccggcagaaucgugguggacuauaugguccaaaagagcgggaaaacaggaaccauuaccuaccagcggggcauccuccugccucagaagguguggugcgcuucugggcgcuccaaaguuauuaagggaagccuuccccugaucggcgaagccgauugucuccaugagaaauauggcgggcugaacaaguccaagcccuacuacacaggagagcacgcgaaagccauuggcaauugcccuaucugggugaagaccccgcugaaacucgcuaacgggacaaaguauagacccccugccaaacugcuuaaggaacggggauuuuucggcgcuaucgccggguuucuggagggcggaugggaaggcaugauugccggguggcauggauacacgucucacggcgcucacggggucgcgguggccgcugaccucaagagcacccaggaggccaucaauaaaauuacaaagaaccuuaauucccuuagcgaacuggagguuaaaaaccuccagcgccugucuggagccauggaugagcugcauaaugaaauccucgagcuggacgaaaagguggacgaucuuagagcugacaccauuuccagccaaaucgagcuggccguccuccugucuaacgaaggcaucauuaauagcgaggaugagcaccuucuggcgcucgaacggaaacugaagaagaugcuggggcccuccgcuguggagaucggcaacggauguuucgaaacaaaacauaagugcaaucagaccugccucgaccgcauugccgccggcacguuugaugcuggggaguucucucugccuaccuuugacagccuuaacaucacagccgcuucccugaaugaugacggacucgauaaccacaccauucugcuguauuacagcacagccgcgucuucccuugccgucacccucaugaucgcuauuuucgugguuuauauggugagcagagacaaugucucuuguuccaucugccuguga

SEQ ID NO: 211539 - RNA, 1755 nt, Artificial Sequence; identical to SEQ ID NO: 211476
  derived and/or modified sequence opt5 from hemagglutinin__InfluenzaB__ALN39797

SEQ ID NO: 211540 - RNA, 1755 nt, Artificial Sequence
  derived and/or modified sequence opt5 from hemagglutinin__InfluenzaB__ALN39798
augaaggccaucauugugcugcucauggucguuaccagcaacgcugacagaaucugcacaggcauuacguccucuagcagcccccacguggugaaaaccgccacacagggggaagucaaugugaccggaguuaucccucugacaaccacaccgaccaagucuuacuucgcgaaccuuaaaggcacgcggacccgcgggaagcugugucccgauugccucaauuguacagaccuggauguggcucuuggaagaccuaugugcgucggcaccacacccagcgccaaagccuccauucugcaugaagugcggccuguuaccucuggguguuuucccaucaugcacgaccgcacgaagaucagacaacucccuaaccugcugcggggauaugagaagauucgccucagcacacagaaugugaucgaugcugaaaaagccccgggcggccccuacagacuggggaccuccggaagcugcccuaacgcuacaucuaagauuggcuucuuugccaccauggcgugggccguccccaaagacaauuauaagaacgcuaccaauccucagacaguggaggugcccuacaucuguacggaaggggaggaucagauuaccgucuggggauuccauuccgacaacaaaacacaaaugaagucccuuuauggcgauucuaauccgcagaaguuuaccuccagcgccaacgggguuacaacccacuacgugucucagaucggagacuucccugaucagacggaggacggcggccugccccaauccgggcggauuguggucgauuauaugaugcagaaaccuggaaagacaggcaccaucguguaccagcgcgggguucuccugccccagaaaguguggugcgcuagcggaagauccaaggucaucaaaggcucucuuccccugauuggggaagccgacugucuccaugaggaauacggaggccugaauaagagcaaaccuuauuacaccggcaagcacgcgaaggccaucgggaacugcccgauuugggugaaaacaccccugaagcucgcuaauggaaccaaauaucggccucccgccaagcugcuuaaagagcgcggcuuuuucggggcuaucgccggauuucuggagggcgggugggaaggcaugauugccggauggcacggcuacacaucccauggggcucacggaguugcgguggccgcugaccucaagagcacgcaagaggccaucaacaagaucaccaaaaaccuuaauucucuguccgaacuggaggucaagaaccuccagagacugagcggcgccauggaugaacugcauaaugagauucucgagcuggacgaaaaaguggaugaccuucgggcugauacaaucucuagccagauugagcuggccguccuccuguccaacgaagggaucauuaauucugaggacgaacaccuucuggcgcucgagcgcaagcugaaaaagaugcugggaccuagcgcuguggauaucggcaacggguguuucgagaccaagcacaaaugcaaucaaacaugccucgacagaaucgccgccggcaccuuuaacgcuggagaguucucccugcccacguuugauagccuuaauauuaccgccgcuucucugaacgacgauggccucgacaaucauacaauccugcuguauuacuccaccgccgcgagcucucuugccguuacacucaugcuggcuauuuucaucguguauauggucucccgggacaacgugagcuguuccauuugccuguga

SEQ ID NO: 211541 - RNA, 1755 nt, Artificial Sequence; identical to SEQ ID NO: 211313
  derived and/or modified sequence opt5 from hemagglutinin__InfluenzaB__ALN39799

SEQ ID NO: 211542 - RNA, 1755 nt, Artificial Sequence
  derived and/or modified sequence opt5 from hemagglutinin__InfluenzaB__ALN39800
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagaagaaacugaagaagaugcugggaccuucugcuguggauaucggcaauggguguuucgagaccaaacacaagugcaaccaaacaugccucgaccgcaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccguuacacucaugcuggcuauuuucaucguguauauggucucuagagacaauguguccuguagcauuugccuguga

SEQ ID NO: 211543 - RNA, 1755 nt, Artificial Sequence; identical to SEQ ID NO: 211533
  derived and/or modified sequence opt5 from hemagglutinin__InfluenzaB__ALN39801

SEQ ID NO: 211544 - RNA, 1755 nt, Artificial Sequence; identical to SEQ ID NO: 211476
  derived and/or modified sequence opt5 from hemagglutinin__InfluenzaB__ALN39802

SEQ ID NO: 211545 - RNA, 1755 nt, Artificial Sequence; identical to SEQ ID NO: 211533
  derived and/or modified sequence opt5 from hemagglutinin__InfluenzaB__ALN39803

SEQ ID NO: 211546 - RNA, 1755 nt, Artificial Sequence; identical to SEQ ID NO: 211472
  derived and/or modified sequence opt5 from hemagglutinin__InfluenzaB__ALN39804

SEQ ID NO: 211547 - RNA, 1758 nt, Artificial Sequence; identical to SEQ ID NO: 211499
  derived and/or modified sequence opt5 from hemagglutinin__InfluenzaB__ALN39805

SEQ ID NO: 211548 - RNA, 1758 nt, Artificial Sequence; identical to SEQ ID NO: 210013
  derived and/or modified sequence opt5 from hemagglutinin__InfluenzaB__ACN29380

SEQ ID NO: 211549 - RNA, 1758 nt, Artificial Sequence; identical to SEQ ID NO: 210345
  derived and/or modified sequence opt5 from hemagglutinin__InfluenzaB__EPI498048

SEQ ID NO: 211550 - RNA, 1758 nt, Artificial Sequence
  derived and/or modified sequence opt5 from hemagglutinin__InfluenzaB__ANC28539
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaagcccagauggcuaaacuuuauggggauucuaagccgcagaaguuuacauccagcgccaacggagucaccacacacuacguuucucaaaucggcggcuucccuaaccagaccgaggacgggggacugccccaguccggcagaauugugguggauuauaugguccaaaagagcgggaaaacgggaacaaucaccuaccagcggggcauucuccugccucagaagguguggugcgcuucugggcgcuccaaaguuaucaagggaagccuuccccugauuggcgaagccgacugucuccaugagaaauauggcgggcugaauaaguccaagcccuacuacaccggagagcacgcgaaagccaucggcaacugcccuaucugggugaagacaccgcugaaacucgcuaaugggaccaaguauagacccccugccaaacugcuuaaggaacggggauuuuucggcgcuauugccggguuucuggagggcggaugggaaggcaugaucgccggguggcauggauacacaucucacggcgcucacggggucgcgguggccgcugaucucaagagcacgcaggaggccauuaacaaaaucaccaagaaucugaacucccuuagcgaacuggagguuaaaaaucuccagcgccugucuggagccauggacgagcugcauaacgaaauucucgagcuggaugaaaagguggacgaccuuagagcugauacaaucuccagccaaaucgagcuggccguccuccugucuaaugaaggcauuaucaacagcgaggacgagcaccuucuggcgcucgaacggaaacugaagaagaugcuggggcccuccgcuguggagauuggcaauggauguuucgaaaccaaacauaagugcaaccagacaugccucgaucgcaucgccgccggcaccuuugacgcuggggaguucucucugccuacguuugauagccuuaauauuaccgccgcuucccugaacgacgauggacucgacaaucacacaauccugcuguauuacagcaccgccgcgucuucccuugccgucacacucaugauugcuaucuucgugguuuauauggugagcagagauaacgucucuuguuccaucugccuguga

SEQ ID NO: 211551 - RNA, 1758 nt, Artificial Sequence
  derived and/or modified sequence opt5 from hemagglutinin__InfluenzaB__EPI827073
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggccuucacagcgacaaugaaauccagauggccaagcuguauggggauucuaagccgcagaaauucacauccagcgcuaacggagucaccacacacuacguuucucaaauuggcggcuuuccuaaccagaccgaggacgggggacucccccaguccggcagaaucgugguggauuauaugguccaaaagagcgggaaaacgggaacaauuaccuaccagcggggcauccugcuuccucagaagguguggugcgccucugggcgcuccaaaguuauuaagggaagccugccccucaucggcgaagcugacugucugcaugagaaauauggcgggcugaauaaguccaagcccuacuacaccggagagcacgccaaagcgaucggcaacugcccuauuugggugaagacaccgcucaaacuggccaaugggaccaaguauagacccccugcuaaacuucugaaggaacggggauucuuuggcgccaucgcuggguuccucgagggcggaugggaaggcaugauugccggguggcauggauacacaucucacggcgcccacggggucgcuguggcggccgaucuuaagagcacgcaggaggcuaucaacaaaauuaccaagaaucugaacucccugagcgaacucgagguuaaaaaucugcagcgccugucuggagccauggacgagcuccauaacgaaauccuggagcuugaugaaaagguggacgaccugagagccgauacaaucuccagccaaauugagcucgcuguccugcuuucuaaugaaggcaucauuaacagcgaggacgagcaucugcucgcccuggaacggaaacugaagaagaugcucgggcccuccgcgguggagaucggcaauggauguuuugaaaccaaacacaagugcaaccagacaugccuggaucgcauugcugccggcaccuucgacgccggggaguuuucucuuccuacguucgauagccugaauaucaccgcugccucccucaacgacgauggacuggacaaucacacaauucugcuuuauuacagcaccgcugccucuucccucgcggucacacugaugaucgccaucuuugugguuuauauggugagcagagauaacgucucuuguuccauuugccuguga

SEQ ID NO: 211552 - RNA, 1758 nt, Artificial Sequence; identical to SEQ ID NO: 209771
  derived and/or modified sequence opt5 from hemagglutinin__InfluenzaB__EPI244699

SEQ ID NO: 211553 - RNA, 1758 nt, Artificial Sequence; identical to SEQ ID NO: 209764
  derived and/or modified sequence opt5 from hemagglutinin__InfluenzaB__EPI244702

SEQ ID NO: 211554 - RNA, 1755 nt, Artificial Sequence; identical to SEQ ID NO: 211153
  derived and/or modified sequence opt5 from hemagglutinin__InfluenzaB__EPI540671

SEQ ID NO: 211555 - RNA, 1755 nt, Artificial Sequence
  derived and/or modified sequence opt5 from hemagglutinin__InfluenzaB__EPI573303
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacgauaaaacacagaugaagucccuguauggcgacagcaauccgcaaaaguuuaccucuuccgccaacgggguuacaacccacuacgugagccagaucggagauuucccugaccagacggaggauggcggccucccccagucugggcggauuguggucgacuauaugaugcaaaaaccuggaaagacaggcaccaucguguaccagcgcgggguucugcuuccccagaaaguguggugcgcuuccggaagaagcaaggucaucaaaggcucccugccccucauuggggaagccgacugucugcaugaggaauacggaggccugaauaagucuaaaccuuauuacaccggcaagcacgcgaaggccaucgggaacugcccgauuugggugaaaacaccccucaagcuggcuaauggaaccaaauaucggccucccgccaagcugcugaaagagcgcggcuuuuucggggcuaucgccggauuucucgagggcgggugggaaggcaugauugccggauggcacggcuacacaagccauggggcucacggaguugcgguggccgcugaucugaaguccacgcaggaggccaucaacaagaucaccaaaaaccuuaauagccugucugaacucgaggucaagaaccugcaaagacuguccggcgccauggacgaacuccauaaugagauucuggagcuugaugaaaaaguggacgaucugcgggcugacacaaucagcucucagauugagcucgccguccugcuuagcaacgaagggaucauuaauuccgaggaugaacaccuucucgcgcuggagcgcaagcugaaaaagaugcucggaccuucugcuguggacaucggcaacggguguuucgagaccaagcacaaaugcaaucagacaugccuggauagaaucgccgccggcaccuuuaacgcuggagaguucagccuucccacguuugacucccugaauauuaccgccgcuagccucaacgaugacggccuggacaaucauacaauccugcuuuauuacucuaccgccgcguccagccucgccguuacacugaugcuggcuauuuucaucguguauauggucucucgggauaacguguccuguagcauuugccucuga

SEQ ID NO: 211556 - RNA, 1755 nt, Artificial Sequence
  derived and/or modified sequence opt5 from hemagglutinin__InfluenzaB__EPI829466
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacgauaaaacacagaugaagucccuguauggcgacagcaauccgcaaaaguuuaccucuuccgccaacgggguuacaacccacuacgugagccagaucggagauuucccugaccagacggaggaugaaggccucccccagucuggccggauuguggucgacuauaugaugcaaaaaccugggaagacaggaaccaucguguaccagcgcggcguucugcuuccccagaaaguguggugcgcuuccgggagaagcaaggucaucaaaggaucccugccccucauuggcgaggccgacugucugcaugaagaguacgggggacugaauaagucuaaaccuuauuacaccggcaagcacgcgaaggccaucggcaacugcccgauuugggugaaaacaccccucaagcuggcuaaugggaccaaauaucggccucccgccaagcugcugaaagagcgcggauuuuucggcgcuaucgccggguuucucgaaggaggcugggaggggaugauugccggcuggcacggauacacaagccauggcgcucacgggguugcgguggccgcugaucugaaguccacgcaggaagccaucaacaagaucaccaaaaaccuuaauagccugucugagcucgaagucaagaaccugcaaagacuguccggagccauggacgagcuccauaaugagauucuggaacuugaugagaaaguggacgaucugcgggcugacacaaucagcucucagauugaacucgccguccugcuuagcaacgagggcaucauuaauuccgaagaugagcaccuucucgcgcuggagcgcaagcugaaaaagaugcucgggccuucugcuguggacaucggaaacggcuguuucgaaaccaagcacaaaugcaaucagacaugccuggauagaaucgccgccgggaccuuuaacgcuggcgaguucagccuucccacguuugacucccugaauauuaccgccgcuagccucaacgaugacggacuggacaaucauacaauccugcuuuauuacucuaccgccgcguccagccucgccguuacacugaugcuggcuauuuucaucguguauauggucucucgggauaacguguccuguagcauuugccucuga

SEQ ID NO: 211557 - RNA, 1755 nt, Artificial Sequence
  derived and/or modified sequence opt5 from hemagglutinin__InfluenzaB__EPI684429
augaaggccaucauugugcugcucauggucguuaugagcaacgcugacagaaucugcaccggcauuacauccucuaauagcccccacguggugaaaacggccacccagggggaagucaacgugacaggaguuaucccucugaccacaaccccgacaaaguccuacuucgcgaaucuuaaaggcacccggacgcgcgggaagcugugucccgauugccucaacuguaccgaccuggauguggcucuuggaagaccuaugugcgucggcacaacccccucugccaaagccagcauucugcaugaagugcggccuguuacauccggguguuuucccaucaugcacgaccgcaccaagaucagacaacucccuaaucugcugcggggauaugagaagauucgccucucuacgcagaacgugaucgaugcugaaaaagccccgggcggccccuacagacuggggacaagcggauccugcccuaaugcuaccagcaagauuggcuucuuugccacaauggcgugggccguccccaaagacaacuauaagaaugcuaccaacccucagaccguggaggugcccuacaucuguacagaaggggaggaucagauuacggucuggggauuccauucugacaauaaaacccaaaugaagucccuuuauggcgauagcaacccgcagaaguuuacaucuuccgccaaugggguuaccacacacuacgugagccagaucggagacuucccugaucagaccgaggacggcggccugccccaaucugggcggauuguggucgauuauauggugcagaaaccuggaaagacgggcacaaucguuuaccagcgcggggugcuccugccccagaaagucuggugcguguccggaagaagcaagguuaucaaaggcucccuuccccugauuggggaagcugacugucuccaugaggaauacggaggccugaacaagucuaaaccuuauuacaccggcaagcacgccaaggcgaucgggaauugcccgauuugggugaaaacaccccugaagcucgccaacggaaccaaauaucggccucccgcuaagcugcuuaaagagcgcggcuuuuucggggccaucgcuggauuucuggagggcgggugggaaggcaugauugccggauggcacggcuacaccagccauggggcccacggagucgcuguggcggccgaccucaaguccacacaagaggcuaucaacaagaucacgaaaaaucugaacagccuuucugaacuggaggucaagaaucuccagagacuguccggcgccauggaugaacugcauaacgagauucucgagcuggacgaaaaaguggaugaccuucgggccgauaccaucagcucucagauugagcuggcuguucuccugagcaaugaagggaucauuaacuccgaggacgaacaccuucuggcccucgagcgcaagcugaaaaagaugcugggaccuucugcgguggauaucggcaauggguguuucgagacaaagcacaaaugcaaccaaaccugccucgacagaaucgcugccggcacauuuaaugccggagaguucagccugcccaccuuugauucccuuaacauuacggcugccagccugaaugacgauggccucgacaaccauaccauccugcuguauuacucuacagcugccuccagccuugcggucacccucaugcuggccauuuucaucguguauaugguuucucgggacaauguguccuguagcauuugccuguga

SEQ ID NO: 211558 - RNA, 1758 nt, Artificial Sequence; identical to SEQ ID NO: 209776
  derived and/or modified sequence opt5 from hemagglutinin__InfluenzaB__AFH58447

SEQ ID NO: 211559 - RNA, 1758 nt, Artificial Sequence
  derived and/or modified sequence opt5 from hemagglutinin__InfluenzaB__EPI173279
augaaggccaucauugugauccugauggucguuaccagcaacgcugacagaauuugcacaggcaucacguccucuaauagcccccacguggugaaaaccgccacacagggggaggucaacgugaccggaguuauuccucucacaaccacaccgaccaagucccauuucgcgaaucugaaaggcacggaaacccgggggaagcugugucccaaaugccugaacuguacagaucucgacguggcucugggacgcccuaagugcaccggcaagauccccucugccagagucagcauccuucacgaggugcggccuguuacauccggguguuuucccauuaugcaugaucgcaccaaaaucagacaacugccuaaucuccugcggggauacgaacacauucgccugucuacgcauaacgugaucaaugccgagaacgcuccgggcggccccuauaagauugggacaagcggauccugcccuaauaucaccaacggcaauggguucuuugccacaauggcuugggccguccccaaaaacgacaagaauaaaaccgcgaccaacccucucacaauugaagugcccuacaucuguacggagggagaggaucagaucaccguguggggcuuccacagcgacucugaaacacagauggccaagcuguauggggauuccaagccgcagaaauuuaccagcucugcuaauggagucacaacccacuacguuucccaaauuggcggcuucccuaaccagacggaggacgggggacuuccccagagcggcagaaucgugguggauuauaugguccagaagucugggaaaacaggaaccauuaccuaccaacggggcauccugcucccucagaagguguggugcgccuccgggcgcagcaaaguuauuaagggaucccugccccuuaucggcgaagcugacugucugcaugagaaauauggcgggcucaacaagucuaagcccuacuacacaggagagcacgccaaagcgaucggcaauugcccuauuugggugaagaccccgcugaaacuggccaacgggacaaaguauagacccccugcuaaacuccugaaggaacggggauuuuucggcgccaucgcuggguuucuugagggcggaugggaaggcaugauugccggguggcauggauacacgagccacggcgcccacggggucgcuguggcggccgaucugaaguccacccaggaggcuaucaauaaaauuacaaagaaccucaauagccugucugaacuugagguuaaaaaccugcagcgccucuccggagccauggacgagcugcauaaugaaauccuggagcucgaugaaaagguggacgaccugagagccgauaccaucagcucucaaauugagcuugcuguccugcucagcaacgaaggcaucauuaauuccgaggacgagcaccuucuugcccuggaacggaaacucaagaagaugcuggggcccucugcgguggagaucggcaacggauguuucgaaacaaaacauaagugcaaucagaccugccuggaucgcauugcugccggcacguuugacgccggggaguucagccucccuaccuuugauucccugaacaucacagcugccagccuuaaugacgauggacuggacaaccacaccauucuccuguauuacucuacagcugccuccagccuggcggucacccuuaugaucgccaucuucgugguuuauauggugucuagagauaaugucuccuguagcauuugccucuga

SEQ ID NO: 211560 - RNA, 1758 nt, Artificial Sequence; identical to SEQ ID NO: 210345
  derived and/or modified sequence opt5 from hemagglutinin__InfluenzaB__EPI163726

SEQ ID NO: 211561 - RNA, 1758 nt, Artificial Sequence; identical to SEQ ID NO: 211499
  derived and/or modified sequence opt5 from hemagglutinin__InfluenzaB__EPI636340

SEQ ID NO: 211562 - RNA, 1758 nt, Artificial Sequence
  derived and/or modified sequence opt5 from hemagglutinin__InfluenzaB__EPI645995
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacgugcgccucucuacgcauaacgucaucaaugccgaggacgcuccgggcggccccuauaagauugggacaagcggauccugcccuaacaucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgaugacgaaacacagauggccaaacuuuauggggauucuaagccgcagaaguuuaccuccagcgcuaacggaguuacaacccacuacgugucucaaaucggcggcuucccuaaucagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaacaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggacgaaaaggucgaugaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagcagagauaacgugucuuguuccaucugccuguga

SEQ ID NO: 211563 - RNA, 1755 nt, Artificial Sequence; identical to SEQ ID NO: 211153
  derived and/or modified sequence opt5 from hemagglutinin__InfluenzaB__EPI539769

SEQ ID NO: 211564 - RNA, 1755 nt, Artificial Sequence; identical to SEQ ID NO: 211555
  derived and/or modified sequence opt5 from hemagglutinin__InfluenzaB__EPI551249

SEQ ID NO: 211565 - RNA, 1755 nt, Artificial Sequence
  derived and/or modified sequence opt5 from hemagglutinin__InfluenzaB__EPI544259
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaauaaaaaccagaugaagucccuguauggcgauagcaauccgcaaaaguuuacaucuuccgccaacgggguuaccacacacuacgugagccagaucggagacuucccugaucagaccgaggacggcggccucccccagucugggcggauuguggucgauuauaugaugcaaaaaccuggaaagacgggcacaaucguguaccagcgcgggguucugcuuccccagaaaguguggugcgcuuccggaagaagcaaggucaucaaaggcucccugccccucauuggggaagccgacugucugcaugaggaauacggaggccugaauaagucuaaaccuuauuacaccggcaagcacgcgaaggccaucgggaacugcccgauuugggugaaaacaccccucaagcuggcuaacggaaccaaauaucggccucccgccaagcugcugaaagagcgcggcuuuuucggggcuaucgccggauuucucgagggcgggugggaaggcaugauugccggauggcacggcuacaccagccauggggcucacggaguugcgguggccgcugaccugaaguccacacaggaggccaucaauaagaucacgaaaaaccuuaauagccugucugaacucgaggucaagaaccugcaaagacuguccggcgccauggaugaacuccauaaugagauucuggagcuugacgaaaaaguggaugaccugcgggcugauaccaucagcucucagauugagcucgccguccugcuuagcaacgaagggaucauuaauuccgaggacgaacaccuucucgcgcuggagcgcaagcugaaaaagaugcucggaccuucugcuguggauaucggcaacggguguuucgagacaaagcacaaaugcaaucagaccugccuggacagaaucgccgccggcacauuuaacgcuggagaguucagccuucccaccuuugauucccugaauauuacggccgcuagccucaacgacgauggccuggacaaucauaccauccugcuuuauuacucuacagccgcguccagccucgccguuacccugaugcuggcuauuuucaucguguauauggucucucgggacaacguguccuguagcauuugccucuga

SEQ ID NO: 211566 - RNA, 1755 nt, Artificial Sequence
  derived and/or modified sequence opt5 from hemagglutinin__InfluenzaB__EPI592699
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaauccaaaugaagucccuuuauggcgauagcaacccgcagaaguuuacaucuuccgccaaugggguuaccacacacuacgugagccagauuggagacuucccugaucagaccgaggacggcggccugccccaaucugggcggaucguggucgauuauauggugcagaaaccuggaaagacgggcacaaucguuuaccagcgcggggugcuccugccccagaaagucuggugcgcuuccggaagaagcaaggugauuaaaggcucccuuccccugaucggggaagccgacugucuccaugaggaauacggaggccugaacaagucuaaaccuuauuacaccggcaagcacgcgaaggccauugggaauugcccgaucuggguuaaaacaccccugaagcucgcuaacggaaccaaauaucggccucccgccaagcugcuuaaagagcgcggcuuuuucggggcuauugccggauuucuggagggcgggugggaaggcaugaucgccggauggcacggcuacaccagccauggggcucacggaguggcggucgccgcugaccucaaguccacacaagaggccaucaacaagauuacgaaaaaucugaacagccuuucugaacuggaggugaagaaucuccagagacuguccggcgccauggaugaacugcauaacgagauccucgagcuggacgaaaaagucgaugaccuucgggcugauaccauuagcucucagaucgagcuggccgugcuccugagcaaugaagggauuaucaacuccgaggacgaacaccuucuggcgcucgagcgcaagcugaaaaagaugcugggaccuucugcuguugauaucggcaauggguguuucgagacaaagcacaaaugcaaccaaaccugccucgacagaauugccgccggcacauuuaaugcuggagaguucagccugcccaccuuugauucccuuaacaucacggccgcuagccugaaugacgauggccucgacaaccauaccauucugcuguauuacucuacagccgcguccagccuugccgugacccucaugcuggcuaucuucauugucuauauggugucucgggacaauguuuccuguagcaucugccuguga

SEQ ID NO: 211567 - RNA, 1755 nt, Artificial Sequence; identical to SEQ ID NO: 211476
  derived and/or modified sequence opt5 from hemagglutinin__InfluenzaB__EPI592707

SEQ ID NO: 211568 - RNA, 1755 nt, Artificial Sequence
  derived and/or modified sequence opt5 from hemagglutinin__InfluenzaB__EPI693094
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcgaguccugcccuaaugcuacaagcaagauuggauucuuugccaccauggcgugggccguccccaaagacaacuauaagaaugcuaccaacccucagacaguggaagugcccuacaucuguacggagggcgaggaucagauuaccgucuggggguuccauucugacaauaaaauccaaaugaagucccuuuauggagauagcaacccgcagaaguuuacaucuuccgccaauggcguuaccacacacuacgugagccagauuggggacuucccugaucagaccgaagacggaggccugccccaaucuggccggaucguggucgauuauauggugcagaaaccugggaagacgggaacaaucguuuaccagcgcggcgugcuccugccccagaaagucuggugcgcuuccgggagaagcaaggugauuaaaggaucccuuccccugaucggcgaggccgacugucuccaugaagaguacgggggacugaacaagucuaaaccuuauuacaccggcaagcacgcgaaggccauuggcaauugcccgaucuggguuaaaacaccccugaagcucgcuaacgggaccaaauaucggccucccgccaagcugcuuaaagagcgcggauuuuucggcgcuauugccggguuucuggaaggaggcugggaggggaugaucgccggcuggcacggauacaccagccauggcgcucacgggguggcggucgccgcugaccucaaguccacacaagaagccaucaacaagauuacgaaaaaucugaacagccuuucugagcuggaagugaagaaucuccagagacuguccggagccauggaugagcugcauaacgagauccucgaacuggacgagaaagucgaugaccuucgggcugauaccauuagcucucagaucgaacuggccgugcuccugagcaaugagggcauuaucaacuccgaagacgagcaccuucuggcgcucgagcgcaagcugaaaaagaugcuggggccuucugcuguugauaucggaaauggcuguuucgaaacaaagcacaaaugcaaccaaaccugccucgacagaauugccgccgggacauuuaaugcuggcgaguucagccugcccaccuuugauucccuuaacaucacggccgcuagccugaaugacgauggacucgacaaccauaccauucugcuguauuacucuacagccgcguccagccuugccgugacccucaugcuggcuaucuucauugucuauauggugucucgggacaauguuuccuguagcaucugccuguga

SEQ ID NO: 211569 - RNA, 1758 nt, Artificial Sequence; identical to SEQ ID NO: 211499
  derived and/or modified sequence opt5 from hemagglutinin__InfluenzaB__EPI678796

SEQ ID NO: 211570 - RNA, 1758 nt, Artificial Sequence
  derived and/or modified sequence opt5 from hemagglutinin__InfluenzaB__EPI721064
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacgugcgccucucuacgcauaacgucaucaaugccgaggacgcuccgggcggccccuauaagauugggacaagcagauccugcccuaacaucaccaauggaaacggcuucuuugccacaauggcuugggccgugcccaaaaaugauaagaacaaaaccgcgaccaauccucugacaauugaagugcccuacaucuguacggagggggaggaccagauuaccgucuggggauuccacagcgauaacgaaacacagauggccaagcuguauggcgacucuaagccgcagaaauuuaccuccagcgcuaaugggguuacaacccacuacgugucucaaaucggaggcuucccuaaccagacggaggauggcgggcugccccaguccggacggaucguggucgacuauauggugcaaaagagcggcaaaacagggaccauuaccuaccagcgcggaauccuccugccucagaagguuuggugcgccucuggcagauccaaagugauuaaggggagccuuccccugaucggagaagcugauugucuccaugagaaauauggcggccugaacaaguccaagcccuacuacacaggggagcacgccaaagcgauuggaaauugcccuaucugggucaagaccccgcugaaacucgccaacggcacaaaguaucggcccccugcuaaacugcuuaaggaacgcggguuuuucggagccaucgcuggcuuucuggaagggggcugggagggaaugauugccggcuggcauggguacacgucucacggagcccacggcguggcuguugcggccgaccucaagagcacccaggaggcuaucaauaaaauuacaaagaaccuuaauucccuuagcgaacuggaggugaaaaaccuccagagacugucuggggccauggaugagcugcauaaugaaauccucgagcuggacgaaaaggucgacgaucuucgggccgacaccauuuccagccaaaucgagcuggcugugcuccugucuaacgaaggaaucauuaauagcgaggaugagcaccuucuggcccucgaacgcaaacugaagaagaugcugggccccuccgcggucgagaucgggaacggcuguuucgaaacaaaacauaagugcaaucagaccugccucgacagaauugcugccggaacguuugaugccggcgaguucucucugccuaccuuugacagccuuaacaucacagcugccucccugaaugaugacgggcucgauaaccacaccauucugcuguauuacagcacagcugccucuucccuugcggugacccucaugaucgccauuuucguuguguauauggucagccgggacaaugugucuuguuccaucugccuguga

SEQ ID NO: 211571 - RNA, 1758 nt, Artificial Sequence; identical to SEQ ID NO: 209780
  derived and/or modified sequence opt5 from hemagglutinin__InfluenzaB__EPI328904

SEQ ID NO: 211572 - RNA, 1755 nt, Artificial Sequence
  derived and/or modified sequence opt5 from hemagglutinin__InfluenzaB__EPI543191
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaaaaagacacagaugaagucccuguauggcgauagcaauccgcaaaaauuuaccucuuccgccaacgggguuacaacccacuacgugagccagaucggagacuucccugaucagacggaggacggcggccucccccagucugggcggauuguggucgauuauaugaugcaaaagccuggaaaaacaggcaccaucguguaccagcgcgggguucugcuuccccagaagguguggugcgcuuccggaagaagcaaagucaucaagggcucccugccccucauuggggaagccgacugucugcaugaggaauacggaggccugaauaaaucuaagccuuauuacaccggcaagcacgcgaaagccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaagccauggggcucacggaguugcgguggccgcugaccugaaguccacgcaggaggccaucaacaaaaucaccaagaaccuuaauagccugucugaacucgaggucaaaaaccugcaaagacuguccggcgccauggaugaacuccauaaugagauucuggagcuugacgaaaagguggaugaccugcgggcugauacaaucagcucucagauugagcucgccguccugcuuagcaacgaagggaucauuaauuccgaggacgaacaucugcucgcgcuggagcgcaaacugaagaagaugcucggaccuucugcuguggauaucggcaacggguguuucgagaccaaacacaagugcaaucagacaugccuggacagaaucgccgccggcaccuuuaacgcuggagaguucagccuucccacguuugauucccugaauauuaccgccgcuagccucaacgacgauggccuggacaaucacacaauccugcuuuauuacucuaccgccgcguccagccucgccguuacacugaugcuggcuauuuucaucguguauauggucucucgggacaacguguccuguagcauuugccucuga

SEQ ID NO: 211573 - RNA, 1755 nt, Artificial Sequence; identical to SEQ ID NO: 211153
  derived and/or modified sequence opt5 from hemagglutinin__InfluenzaB__EPI500359

SEQ ID NO: 211574 - RNA, 1755 nt, Artificial Sequence
  derived and/or modified sequence opt5 from hemagglutinin__InfluenzaB__EPI543185
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaaaccaaaugaagucccuuuauggcgauagcaauccgcagaaguuuacaucuuccgccaacgggguuaccacacacuacgugagccagaucggagacuucccugaucagaccgaggacggcggccugccccaaucugggcggauuguggucgauuauaugaugcagaaaccuggaaagacgggcacaaucguguaccagcgcgggguucuccugccccagaaaguguggugcgcuuccggaagaagcaaggucaucaaaggcucccuuccccugauuggggaagccgacugucuccaugaggaauacggaggccugaauaagucuaaaccuuauuacaccggcaagcacgcgaaggccaucgggaacugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacaccagccauggggcucacggaguugcgguggccgcugaccucaaguccacacaagaggccaucaauaagaucacgaaaaaccugaauagccuuucugaacuggaggucaagaaccuccagagacuguccggcgccauggaugaacugcauaaugagauucucgagcuggacgaaaaaguggaugaccuucgggcugauaccaucagcucucagauugagcuggccguccuccugagcaacgaagggaucauuaauuccgaggacgaacaccuucuggcgcucgagcgcaagcugaaaaagaugcugggaccuucugcuguggauaucggcaacggguguuucgagacaaagcacaaaugcaaucaaaccugccucgacagaaucgccgccggcacauuuaacgcuggagaguucagccugcccaccuuugauucccuuaauauuacggccgcuagccugaacgacgauggccucgacaaucauaccauccugcuguauuacucuacagccgcguccagccuugccguuacccucaugcuggcuauuuucaucguguauauggucucucgggacaacguguccuguagcauuugccuguga

SEQ ID NO: 211575 - RNA, 1755 nt, Artificial Sequence; identical to SEQ ID NO: 211313
  derived and/or modified sequence opt5 from hemagglutinin__InfluenzaB__EPI536447

SEQ ID NO: 211576 - RNA, 1755 nt, Artificial Sequence; identical to SEQ ID NO: 209782
  derived and/or modified sequence opt5 from hemagglutinin__InfluenzaB__NP_056660

SEQ ID NO: 211577 - RNA, 1755 nt, Artificial Sequence
  derived and/or modified sequence opt5 from hemagglutinin__InfluenzaB__ABG85167
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgacccggucccauuucgcgaaucuuaagggcacgcaaacccgcgggaaacugugucccaacugcuuuaauuguacagaucucgacguggcucugggaagaccuaagugcaugggcaacauucccucugccaaagucagcauccuucacgaagugaagccuguuaccuccggguguuuccccaucaugcaugaucggacaaagauucgccagcugccuaaucuccugagaggauacgagaacauccggcugucuaccagcaaugugauuaacgccgaaacggcuccgggcggccccuauaaagucgggacauccggaagcugcccuaauguggccaaccgcaauggcuuuuucaacaccauggcuugggugauccccaaggacaauaacaaaacagccauuaacccugucaccguugaggugcccuacaucuguucugaaggggaggaucagauuaccguguggggauuucacuccgacgauaagacacagauggagagacucuauggcgacagcaauccgcaaaaauucacgucuuccgcgaacggggucaccacacauuacgugagccagaucggaggcuuuccuaaucagaccgaagaugagggccugaagcagucugggcggaucguuguggacuauaugguccaaaagcccggaaaaacaggcaccauuguguaccagcgcgggauccuucugccucagaagguuuggugcgccuccggaagaagcaaagugauuaagggcucccucccccugaucggggaagcugauugucuucacgagaaauauggaggccugaacaagucuaaacccuacuacacgggcgagcacgccaaggcuauugggaauugcccuaucugggucaagacaccgcucaaacuggccaacggaaccaaguaucggcccccugcgaaacugcucaaggaacgcggcuucuuuggggccaucgcuggauuccuggagggcgggugggaaggcaugauugccggauggcauggcuacaccagccacggggcucauggaguggccgucgccgcugaccuuaaauccacacaggaggcgaucaauaagauuaccaagaaccugaauagccucucugaacuggaggugaaaaaccuucaaagacuguccggcgccaugaaugggcuccacgaugagauccuggaacuggacgagaagguugacgaucuccgggcugacacaauuagcucucagaucgaacuggccgugcuucugagcaacgagggaaucauuaauuccgaagaugagcaccuccuggcccuugagcgcaaacugaagaaaaugcucggccccucugcugucgaaaucgggaacggcuguuuugagacgaagcauaagugcaaucagaccugccuggacagaauugccgcgggaacauucaacgcuggcgauuuuagccugccuaccuucgacucccucaacaucacagccgccagccugaaugaugacgaucuugacaaccacaccauucugcucuauuacucuacggcugccuccagccuggcugugacccugaugaucgccauuuucaucguuuauauggugucucgggauaaugucuccuguagcaucugccuuuga

SEQ ID NO: 211578 - RNA, 1755 nt, Artificial Sequence
  derived and/or modified sequence opt5 from hemagglutinin__InfluenzaB__EPI376346
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacgauaaaacccagaugaagaaucuguacggcgacagcaacccccaaaaguuuacaucuuccgccaaugggguuaccacacacuaugugagccagauuggaggcuucccggaucagaccgaggacggcgggcucccucagucuggaagaaucguggucgauuacaugaugcaaaaacccggcaagacggggacaauuguguaucagcggggaguucugcuuccucagaaaguguggugcgcguccggccgcagcaaggucaucaaagggucccugccccucaucggagaagccgacugucugcaugagaaguacggcggccugaacaaaucuaagcccuacuauaccggggaacacgcuaaggccauuggaaacugcccuaucugggugaaaaccccgcucaagcuggcuaauggcacaaaauacagacccccugccaagcugcugaaagagcggggguuuuucggagccauugcuggcuuucucgaagggggcugggaaggaaugaucgcgggcuggcacggguauaccagccauggagcccacggcguugcuguggccgccgaccugaaguccacacaggaggcuauuaacaagaucacgaaaaaucuuaacagccugucugaacucgaggucaagaaucugcaacgccuguccggggccauggaugaacuccauaacgagauccuggagcuugacgaaaaaguggaugaccugagagcggauaccauuagcucucagaucgagcucgcuguccugcuuagcaaugaaggaauuaucaacuccgaggacgaacaccuucucgcccuggagcggaagcugaaaaagaugcucggccccucugccguggauauugggaauggcuguuucgagacaaagcacaaaugcaaccagaccugccuggaccgcaucgcugccggaacauuuaaugcuggcgaguucagccuuccuaccuuugauucccugaacaucacggccgcgagccucaaugacgaugggcuggacaaccauaccauucugcuuuacuauucuacagccgcuuccagccucgccguuacccugaugcuggcuaucuucauuguguacauggucucuagagacaauguguccuguagcaucugccucuga

SEQ ID NO: 211579 - RNA, 1755 nt, Artificial Sequence; identical to SEQ ID NO: 209878
  derived and/or modified sequence opt5 from hemagglutinin__InfluenzaB__EPI368425

SEQ ID NO: 211580 - RNA, 1755 nt, Artificial Sequence; identical to SEQ ID NO: 209844
  derived and/or modified sequence opt5 from hemagglutinin__InfluenzaB__ACH53430

SEQ ID NO: 211581 - RNA, 1758 nt, Artificial Sequence; identical to SEQ ID NO: 209669
  derived and/or modified sequence opt5 from hemagglutinin__InfluenzaB__EPI331151

SEQ ID NO: 211582 - RNA, 1758 nt, Artificial Sequence
  derived and/or modified sequence opt5 from hemagglutinin__InfluenzaB__EPI356777
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacgaugaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcaaaagagcgggaaaacaggaaccauuaccuaccagcggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaccucaagagcacccaggaggcuaucaauaaaauuacaaagaaccuuaauucccuuagcgaacuggaggugaaaaaccuccagcgccugucuggagccauggaugagcugcauaaugaaauccucgagcuggacgaaaaggucgacgaucuuagagccgacaccauuuccagccaaaucgagcuggcugugcuccugucuaacgaaggcaucauuaauagcgaggaugagcaccuucuggcccucgaacggaaacugaagaagaugcuggggcccuccgcggucgagaucggcaacggauguuucgaaacaaaacauaagugcaaucagaccugccucgaccgcauugcugccggcacguuugaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagcagagacaaugugucuuguuccaucugccuguga

SEQ ID NO: 211583 - RNA, 1752 nt, Artificial Sequence; identical to SEQ ID NO: 209451
  derived and/or modified sequence opt5 from hemagglutinin__InfluenzaB__CY018349

SEQ ID NO: 211584 - RNA, 1752 nt, Artificial Sequence
  derived and/or modified sequence opt5 from hemagglutinin__InfluenzaB__AY581945
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuugcccgcccuaugugcgucggaaccacacccucugccaaggcuagcauucugcacgaagugagaccuguuaccuccggcuguuuucccaucaugcaugaucggacgaagauccgccaacucccuaaccugcugagaggguacgagaauauucggcucucuacacagaacgugaucaaugccgaacgcgcuccgggaggccccuauagacugggcaccagcggguccugcccuaacgucacaagccgggacggauucuuugccaccauggcgugggccgugccccgcgauaauaaaaccgcuacaaacccucuuacgguggagguccccuacauuuguaccaagggcgaagaccagaucacaguuuggggguuccacucugauaauaaaacccagaugaagaaccuguauggagacuccaauccgcaaaaauuuacaagcucugccaacggcgugaccacgcauuacgugucccagauugggggauucccuaaccagacagaggauggcggccucccccagagcgggagaaucgucguggacuauaugguucaaaagccuggaaagaccggcaccauuguguaccagcgcgggguccugcuuccccagaaaguguggugcgcuucuggacgguccaagguuaucaaaggcagccugccccucaucggggaggccgauugucugcacgaaaaguauggaggccugaauaaauccaagccuuacuacacaggcgagcacgcgaaagccauugggaacugcccgaucugggugaagacaccccucaagcuggcuaauggaaccaaauauagaccucccgccaagcugcugaaagaacggggcuuuuucggggcuauugccggauuucucgagggcgggugggagggcaugaucgccggauggcauggcuacacgucucacggggcucauggagucgcgguggccgcugaccuuaagagcacccaggaagccauuaacaaaaucacaaagaaucuuaacucccugagcgagcucgaagucaagaaucugcaacgccugucuggcgccauggaugagcuccacaacgaaauccuggagcuugacgagaaaguggacgaucugagagcugacaccauuuccagccagaucgaacucgccguucugcuuucuaaugaggggauuaucaacagcgaagaugagcaucugcucgcgcuggaacggaagcugaaaaagaugcucggaccuuccgcuguggacauuggcaauggguguuucgagacaaaacacaagugcaaccagaccugccuggauagaaucgccgccggcacguuuaaugcuggagaguucucucuucccaccuuugacagccugaacaucacagccgcuucccucaaugaugacggccuggauaaccacaccauucugcuuuauuacagcacagccgcgucuucccucgccgucacccugaugaucgcuauuuucaucguguauaugguuagccgcgacaacgugucuuguuccauuugccuguga

SEQ ID NO: 211585 - RNA, 1755 nt, Artificial Sequence; identical to SEQ ID NO: 211332
  derived and/or modified sequence opt5 from hemagglutinin__InfluenzaB__EPI541351

SEQ ID NO: 211586 - RNA, 1755 nt, Artificial Sequence
  derived and/or modified sequence opt5 from hemagglutinin__InfluenzaB__EPI541760
augaaggccgugaucguccugcucaugguugugaccagcaacgcugacagaauuugcacaggcaucacguccucuaauagcccccacguggucaaaaccgccacacagggggaagugaacguuaccggagugauuccucugacaaccacaccgaccaaguccuacuucgcgaaucuuaaaggcacgcggacccgcgggaagcugugucccgauugccucaacuguacagaccuggaugucgcucuuggaagaccuaugugcgugggcaccacacccucugccaaagccagcauccugcaugaaguucggccugugaccuccggguguuuucccauuaugcacgaccgcacgaagaucagacaacucccuaaucugcugcggggauaugagaagauccgccucucuacacagaacgucauugaugcugaaaaagccccgggcggccccuacagacuggggaccagcggauccugcccuaaugcuacaagcaagaucggcuucuuugccaccauggcgugggccgugcccaaagacaacuauaagaaugcuaccaacccucuuacaguggagguccccuacauuuguacggaaggggaggaucagaucaccguuuggggauuccauucugacaauaaaacacagaugaagucccuguauggcgauagcaacccgcaaaaguuuaccucuuccgccaauggggugacaacccacuacgugagccagauuggagacuucccugaucagacggaggacggcggccucccccagucugggcggaucgucguggauuauaugaugcaaaaaccuggaaagacaggcaccauuguuuaccagcgcggggugcugcuuccccagaaagucuggugcgcuuccggaagaagcaaggugaucaaaggcucccugccccucaucggggaagccgacugucugcaugaggaauacggaggccugaacaagucuaaaccuuauuacaccggcaagcacgcgaaggccauugggaauugcccgaucuggguuaaaacaccccucaagcuggcuaacggaaccaaauaucggccucccgccaagcugcugaaagagcgcggcuuuuucggggcuauugccggauuucucgagggcgggugggaaggcaugaucgccggauggcacggcuacacaagccauggggcucacggaguggcggucgccgcugaccugaaguccacgcaggaggccauuaacaagaucaccaaaaaucuuaacagccugucugaacucgaggugaagaaucugcaaagacuguccggcgccauggaugaacuccauaacgagauccuggagcuugacgaaaaagucgaugaccugcgggcugauacaauuagcucucagaucgagcucgccgugcugcuuagcaaugaagggauuaucaacuccgaggacgaacaccuucucgcgcuggagcgcaagcugaaaaagaugcucggaccuucugcuguugauauuggcaauggguguuucgagaccaagcacaaaugcaaccagacaugccuggacagaaucgccgccggcaccuuuaaugcuggagaguucagccuucccacguuugauucccugaacaucaccgccgcuagccucaaugacgauggccuggacaaccauacaauucugcuuuauuacucuaccgccgcguccagccucgccgugacacugaugcuggcuaucuucauugucuauauggugucucgggacaauguuuccuguagcaucugccucuga

SEQ ID NO: 211587 - RNA, 1758 nt, Artificial Sequence; identical to SEQ ID NO: 209911
  derived and/or modified sequence opt5 from hemagglutinin__InfluenzaB__EPI477397

SEQ ID NO: 211588 - RNA, 1758 nt, Artificial Sequence
  derived and/or modified sequence opt5 from hemagglutinin__InfluenzaB__EPI492571
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaucgaaacacagauggccaaacuuuauggggacucuaagccgcagaaguuuaccuccagcgcuaacggaguuacaacccacuacgugucucaaaucggcggcuucccuaaucagacggaggaugggggacugccccaguccggcagaauuguggucgacuauauggugcaaaagagcgggaaaacaggaaccaucaccuaccagcggggcauucuccugccucagaagguuuggugcgccucugggcgcuccaaagugaucaagggaagccuuccccugauuggcgaagcugauugucuccaugagaaauauggcgggcugaacaaguccaagcccuacuacacaggagagcacgccaaagcgaucggcaacugcccuaucugggucaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacgggguggcuguugcggccgaccucaagagcacccaggaggcuauuaacaaaaucacaaagaaucugaacucccuuagcgaacuggaggugaaaaaucuccagcgccugucuggagccauggaugagcugcauaacgaaauucucgagcuggacgaaaaggucgacgaucuuagagccgacaccaucuccagccaaaucgagcuggcugugcuccugucuaaugaaggcauuaucaacagcgaggaugagcaccuucuggcccucgaacggaaacugaagaagaugcuggggcccuccgcggucgagauuggcaauggauguuucgaaacaaaacauaagugcaaccagaccugccucgaccgcaucgcugccggcacguuugaugccggggaguucucucugccuaccuuugacagccuuaauauuacagcugccucccugaacgaugacggacucgauaaucacaccauccugcuguauuacagcacagcugccucuucccuugcggugacccucaugauugccaucuucguuguguauauggucagcagagacaacgugucuuguuccaucugccuguga

SEQ ID NO: 211589 - RNA, 1758 nt, Artificial Sequence
  derived and/or modified sequence opt5 from hemagglutinin__InfluenzaB__EPI498340
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaauacagaggacgccccgggcggccccuauaagaucgggaccagcggauccugcccuaacgucacaaauggcaacggguucuuugcuaccauggccugggcugugcccaaaaaugauaagaacaaaaccgccacaaauccucugacgauugaagugcccuacaucuguaccgagggagaggaccagauuacagucuggggcuuccacagcgauaucgaaacccagauggcgaaacuuuauggggacucuaagccgcagaaguuuacauccagcgccaacggaguuaccacgcacuacgugucucaaaucggcggcuucccuaaucagacagaggaugggggacugccccaguccggcagaauuguggucgacuauauggugcaaaagagcgggaaaaccggaaccaucacauaccagcggggcauucuccugccucagaagguuuggugcgcuucugggcgcuccaaagugaucaagggaagccuuccccugauuggcgaagccgauugucuccaugagaaauauggcgggcugaacaaguccaagcccuacuacaccggagagcacgcuaaagccaucggcaacugcccuaucugggucaagacaccgcugaaacucgcgaaugggacgaaguauagacccccugccaaacugcuuaaggaacggggauuuuucggcgcuauugccggguuucuggagggcggaugggaaggcaugaucgcuggguggcauggauacaccucucacggcgcccacgggguggccguugcugcggaccucaagagcacacaggaggccauuaacaaaaucaccaagaaucugaacucccuuagcgaacuggaggugaaaaaucuccagcgccugucuggagcuauggaugagcugcauaacgaaauucucgagcuggacgaaaaggucgacgaucuuagagccgacacaaucuccagccaaaucgagcuggccgugcuccugucuaaugaaggcauuaucaacagcgaggaugagcaccuucuggcucucgaacggaaacugaagaagaugcuggggcccuccgccgucgagauuggcaauggauguuucgaaaccaaacauaagugcaaccagacgugccucgaccgcaucgcggcuggcaccuuugaugccggggaguucucucugccuacauuugacagccuuaauauuaccgccgcuucccugaacgaugacggacucgauaaucacacaauccugcuguauuacagcaccgccgcuucuucccuugccgugacgcucaugauugcgaucuucguuguguauauggucagcagagacaacgugucuuguuccaucugccuguga

SEQ ID NO: 211590 - RNA, 1758 nt, Artificial Sequence
  derived and/or modified sequence opt5 from hemagglutinin__InfluenzaB__EPI516490
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaauccagauggccaagcuguauggggacucuaagccgcagaaauuuacauccagcgcuaauggaguuaccacacacuacgugucucaaaucggcggcuucccuaaccagaccgaggaugggggacugccccaguccggcagaauuguggucgacuauauggugcaaaagagcgggaaaacgggaacaaucaccuaccagcggggcauucuccugccucagaagguuuggugcgccucugggcgcuccaaagugaucaagggaagccuuccccugauuggcgaagcugauugucuccaugagaaauauggcgggcugaacaaguccaagcccuacuacaccggagagcacgccaaagcgaucggcaauugcccuaucugggucaagacaccgcugaaacucgccaacgggaccaaguauagacccccugcuaaacugcuuaaggaacggggauuuuucggcgccauugcuggguuucuggagggcggaugggaaggcaugaucgccggguggcauggauacacaucucacggcgcccacgggguggcuguugcggccgaccucaagagcacgcaggaggcuauuaauaaaaucaccaagaaccuuaauucccuuagcgaacuggaggugaaaaaccuccagcgccugucuggagccauggaugagcugcauaaugaaauucucgagcuggacgaaaaggucgacgaucuuagagccgacacaaucuccagccaaaucgagcuggcugugcuccugucuaacgaaggcauuaucaauagcgaggaugagcaccuucuggcccucgaacggaaacugaagaagaugcuggggcccuccgcggucgagauuggcaacggauguuucgaaaccaaacauaagugcaaucagacaugccucgaccgcaucgcugccggcaccuuugaugccggggaguucucucugccuacguuugacagccuuaacauuaccgcugccucccugaaugaugacggacucgauaaccacacaauccugcuguauuacagcaccgcugccucuucccuugcggugacacucaugauugccaucuucguuguguauauggucagcagagacaaugugucuuguuccaucugccuguga

SEQ ID NO: 211591 - RNA, 1755 nt, Artificial Sequence; identical to SEQ ID NO: 211153
  derived and/or modified sequence opt5 from hemagglutinin__InfluenzaB__EPI538119

SEQ ID NO: 211592 - RNA, 1755 nt, Artificial Sequence; identical to SEQ ID NO: 211572
  derived and/or modified sequence opt5 from hemagglutinin__InfluenzaB__EPI538125

SEQ ID NO: 211593 - RNA, 1755 nt, Artificial Sequence
  derived and/or modified sequence opt5 from hemagglutinin__InfluenzaB__EPI556422
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaucaaaacacagaugaagucccuguauggcgauagcaauccgcaaaaguuuaccucuuccgccaacgggguuacaacccacuacgugagccagauuggagacuucccugaucagacggaggacggcggccucccccagucugggcggaucguggucgauuauaugaugcaaaaaccuggaaagacaggcaccaucguguaccagcgcgggguucugcuuccccagaaaguguggugcgcuuccggaagaagcaaggucauuaaaggcucccugccccucaucggggaagccgacugucugcaugaggaauacggaggccugaauaagucuaaaccuuauuacaccggcaagcacgcgaaggccauugggaacugcccgaucugggugaaaacaccccucaagcuggcuaauggaaccaaauaucggccucccgccaagcugcugaaagagcgcggcuuuuucggggcuauugccggauuucucgagggcgggugggaaggcaugaucgccggauggcacggcuacacaagccauggggcucacggaguugcgguggccgcugaccugaaguccacgcaggaggccaucaacaagauuaccaaaaaccuuaauagccugucugaacucgaggucaagaaccugcaaagacuguccggcgccauggaugaacuccauaaugagauccuggagcuugacgaaaaaguggaugaccugcgggcugauacaauuagcucucagaucgagcucgccguccugcuuagcaacgaagggauuaucaauuccgaggacgaacaccuucucgcgcuggagcgcaagcugaaaaagaugcucggaccuucugcuguggauaucggcaacggguguuucgagaccaagcacaaaugcaaucagacaugccuggacagaauugccgccggcaccuuuaacgcuggagaguucagccuucccacguuugauucccugaauaucaccgccgcuagccucaacgacgauggccuggacaaucauacaauucugcuuuauuacucuaccgccgcguccagccucgccguuacacugaugcuggcuaucuucauuguguauauggucucucgggacaacguguccuguagcaucugccucuga

SEQ ID NO: 211594 - RNA, 1755 nt, Artificial Sequence
  derived and/or modified sequence opt5 from hemagglutinin__InfluenzaB__EPI614608
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuaucaccuccggguguuuucccaucaugcacgaccgcacgaagauuagacaacucccuaaucugcugcggggauaugagaagauccgccucucuacacagaacguuauugaugcugaaaaagccccgggcggccccuacagacuggggaccagcggauccugcccuaaugcuacaagcaagaucggcuucuuugccaccauggcgugggccgugcccaaagacaacuauaagaaugcuaccaacccucuuacagucgaggugcccuacauuuguacggaaggggaggaucagaucaccguguggggauuccauucugacgagaaaacacagaugaagucccuguauggcgauagcaauccgcaaaaguuuaccucuuccgccaacggggucacaacccacuacguuagccagauuggagacuucccugaucagacggaagacggcggccucccccagucugggcggaucgugguggauuauaugaugcaaaaaccuggaaagacaggcaccaucgucuaccagcgcggggugcugcuuccccagaaaguuuggugcgcuuccggaagaagcaaggugauuaaaggcucccugccccucaucggggaggccgacugucugcaugaagaguacggaggccugaauaagucuaaaccuuauuacaccggcaagcacgcgaaggccauugggaacugcccgaucugggucaaaacaccccucaagcuggcuaauggaaccaaauaucggccucccgccaagcugcugaaagagcgcggcuuuuucggggcuauugccggauuucucgaaggcgggugggagggcaugaucgccggauggcacggcuacacaagccauggggcucacggaguggcgguugccgcugaccugaaguccacgcaggaagccaucaacaagauuaccaaaaaccuuaauagccugucugagcucgaagugaagaaccugcaaagacuguccggcgccauggaugagcuccauaaugagauccuggaacuugacgagaaagucgaugaccugcgggcugauacaauuagcucucagaucgaacucgccgugcugcuuagcaacgaggggauuaucaauuccgaagacgagcaccuucucgcgcuggagcgcaagcugaaaaagaugcucggaccuucugcugucgauaucggcaacggguguuucgaaaccaagcacaaaugcaaucagacaugccuggacagaauugccgccggcaccuuuaacgcuggagaguucagccuucccacguuugauucccugaauaucaccgccgcuagccucaacgacgauggccuggacaaucauacaauucugcuuuauuacucuaccgccgcguccagccucgccgugacacugaugcuggcuaucuucauuguuuauauggugucucgggacaacgucuccuguagcaucugccucuga

SEQ ID NO: 211595 - RNA, 1755 nt, Artificial Sequence
  derived and/or modified sequence opt5 from hemagglutinin__InfluenzaB__EPI614610
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacgagaaaacacagaugaagucccuguauggcgauagcaauccgcaaaaguuuaccucuuccgccaacgggguuacaacccacuacgugagccagaucggagacuucccugaucagacggaagacggcggccucccccagucugggcggauuguggucgauuauaugaugcaaaaaccuggaaagacaggcaccaucguguaccagcgcgggguucugcuuccccagaaaguguggugcgcuuccggaagaagcaaggucaucaaaggcucccugccccucauuggggaggccgacugucugcaugaagaguacggaggccugaauaagucuaaaccuuauuacaccggcaagcacgcgaaggccaucgggaacugcccgauuugggugaaaacaccccucaagcuggcuaauggaaccaaauaucggccucccgccaagcugcugaaagagcgcggcuuuuucggggcuaucgccggauuucucgaaggcgggugggagggcaugauugccggauggcacggcuacacaagccauggggcucacggaguugcgguggccgcugaccugaaguccacgcaggaagccaucaacaagaucaccaaaaaccuuaauagccugucugagcucgaagucaagaaccugcaaagacuguccggcgccauggaugagcuccauaaugagauucuggaacuugacgagaaaguggaugaccugcgggcugauacaaucagcucucagauugaacucgccguccugcuuagcaacgaggggaucauuaauuccgaagacgagcaccuucucgcgcuggagcgcaagcugaaaaagaugcucggaccuucugcuguggauaucggcaacggguguuucgaaaccaagcacaaaugcaaucagacaugccuggacagaaucgccgccggcaccuuuaacgcuggagaguucagccuucccacguuugauucccugaauauuaccgccgcuagccucaacgacgauggccuggacaaucauacaauccugcuuuauuacucuaccgccgcguccagccucgccguuacacugaugcuggcuauuuucaucguguauauggucucucgggacaacguguccuguagcauuugccucuga

SEQ ID NO: 211596 - RNA, 1758 nt, Artificial Sequence
  derived and/or modified sequence opt5 from hemagglutinin__InfluenzaB__AAA43697
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuugcccgcccuaagugcaugggaaccauucccucugccaaagcuagcauccugcacgaagucaagccugugacauccggcuguuuucccaucaugcaugauagaaccaaaauucggcaacucccuaaucugcugcgcggguacgagcacaucagacucucuacgcauaacguuauuaaugccgaaacagcuccgggaggccccuauaaggugggcaccagcggguccugcccuaacgucacaaauggaaacggcuucuuugccaccauggcgugggccgugcccaaaaaugacaacaauaagaccgcuacaaacccucugacgguggagguccccuacaucuguaccgaaggggaggaucagauuacaguuuggggauuccacagcgacucugagacccagauggugaaacuuuauggcgauuccaaaccgcagaaguuuacaagcucugccaauggggugaccacgcacuacgucucccaaaucggaggcuucccuaaccaggcugaagacggcgggcugccccagagcggacggauugugguugauuauauggugcagaaaucuggcaagacagggaccaucaccuaccaacgcggaauccuccugccucagaaagucuggugcgccuccggcagaagcaaggugauuaaagggucccuuccccugaucggagaggcggacugucuccaugaaaaguauggcggccugaacaagucuaaacccuacuacacaggggagcacgccaaggcuauuggaaauugcccuaucuggguuaaaaccccgcugaagcucgccaacggcacaaaauaucggcccccugcuaagcugcuuaaggagcgcggguuuuucggagccauugccggcuuucuggaagggggcugggagggaaugaucgcuggcuggcauggguacacgagccacggagcgcacggcguggccgucgcugccgaucucaaauccacccaggaagccaucaauaagauuacaaagaaccugaauagccuuucugagcuggaagugaagaaccuccagagacuguccggggcuauggacgagcugcauaaugagauccucgaacuggaugagaaagucgacgaccuucgggccgauaccauuagcucucaaaucgaacuggcggugcuccugagcaacgagggaauuaucaauuccgaagacgagcaccuucuggcucucgagcgcaagcugaagaaaaugcugggccccucugccguugaaaucgggaacggcuguuucgagacaaagcauaaaugcaaucagaccugccucgauagaauugccgcuggaacguuuaacgccggcgaguucagccugccuaccuuugacucccuuaauaucacagcugccagccugaacgaugacgggcucgauaaucacaccauucugcuguauuacucuacagcggccuccagccuugcugugacccucaugaucgccauuuucaucgucuauauggugucucgggacaacguuuccuguagcauuugccuguga

SEQ ID NO: 211597 - RNA, 1755 nt, Artificial Sequence
  derived and/or modified sequence opt5 from hemagglutinin__InfluenzaB__EPI271545
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaucccuguauggcgauagcaauccgcaaaaguuuaccucuuccgccaacgggguuacaacccacuacgugagccagaucggagacuucccugaucagacggaggacggcggccucccccagucugggcggauuguggucgauuauaugaugcaaaagccuggaaaaacaggcaccaucguguaccagcgcgggguucugcuuccccagaagguguggugcgcuuccggaagaagcaaagucaucaagggcucccugccccucauuggggaagccgacugucugcaugagaaauacggaggccugaauaagucuaaaccuuauuacaccggcgaacacgcgaaggccaucgggaacugcccgauuugggugaagacaccccucaaacuggcuaacggaaccaaguaucggccucccgccaaacuucugaaggagcgcggcuuuuucggggcuaucgccggauuucucgagggcgggugggaaggcaugauugccggauggcacggcuacacaagccauggggcucacggaguugcgguggccgcugaccugaaauccacgcaggaggccaucaauaagaucaccaagaaccuuaauagccugucugaacucgaggucaaaaaccugcaaagacuguccggcgccauggaugaacuccauaaugagauucuggagcuugacgaaaagguggaugaccugcgggcugauacaaucagcucucagauugagcucgccguccugcuuagcaacgaagggaucauuaauuccgaggacgaacaucugcucgcgcuggagcgcaaacugaagaaaaugcucggaccuucugcuguggauaucggcaacggguguuucgagaccaagcacaagugcaaucagacaugccuggacagaaucgccgccggcaccuuuaacgcuggagaguucagccuucccacguuugauucccugaauauuaccgccgcuagccucaacgacgauggccuggacaaucacacaauccugcuuuauuacucuaccgccgcguccagccucgccguuacacugaugcuggcuauuuucaucguguauauggucucucgggacaacguguccuguagcauuugccucuga

SEQ ID NO: 211598 - RNA, 1755 nt, Artificial Sequence
  derived and/or modified sequence opt5 from hemagglutinin__InfluenzaB__AGB08329
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagauccagaugaaaucccuguauggcgauagcaauccgcaaaaguuuacaucuuccgccaacgggguuaccacacacuacgugagccagauuggagacuucccugaucagaccgaggacggcggccucccccagucugggcggaucguggucgauuauaugaugcaaaagccuggaaaaacgggcacaaucguguaccagcgcgggguucugcuuccccagaagguguggugcgcuuccggaagaagcaaagucauuaagggcucccugccccucaucggggaagccgacugucugcaugagaaauacggaggccugaauaagucuaaaccuuauuacaccggcgaacacgcgaaggccauugggaacugcccgaucugggugaagacaccccucaaacuggcuaacggaaccaaguaucggccucccgccaaacuucugaaggagcgcggcuuuuucggggcuauugccggauuucucgagggcgggugggaaggcaugaucgccggauggcacggcuacaccagccauggggcucacggaguugcgguggccgcugaccugaaauccacacaggaggccaucaauaagauuacgaagaaccuuaauagccugucugaacucgaggucaaaaaccugcaaagacuguccggcgccauggaugaacuccauaaugagauccuggagcuugacgaaaagguggaugaccugcgggcugauaccauuagcucucagaucgagcucgccguccugcuuagcaacgaagggauuaucaauuccgaggacgaacaucugcucgcgcuggagcgcaaacugaagaaaaugcucggaccuucugcuguggauaucggcaacggguguuucgagacaaagcacaagugcaaucagaccugccuggacagaauugccgccggcacauuuaacgcuggagaguucagccuucccaccuuugauucccugaauaucacggccgcuagccucaacgacgauggccuggacaaucacaccauucugcuuuauuacucuacagccgcguccagccucgccguuacccugaugcuggcuaucuucauuguguauauggucucucgggacaacguguccuguagcaucugccucuga

SEQ ID NO: 211599 - RNA, 1755 nt, Artificial Sequence; identical to SEQ ID NO: 209779
  derived and/or modified sequence opt5 from hemagglutinin__InfluenzaB__EPI294880

SEQ ID NO: 211600 - RNA, 1752 nt, Artificial Sequence; identical to SEQ ID NO: 209490
  derived and/or modified sequence opt5 from hemagglutinin__InfluenzaB__CY018765

SEQ ID NO: 211601 - RNA, 1401 nt, Artificial Sequence
  derived and/or modified sequence opt5 from neuraminidase_glycoprotein__InfluenzaB__AAN39743
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauugcgccaacgcgucuaaugugcaagcugugaaccacagcgccacagaggaaaugaccuuccuucugcccgagccugaauggacauaucccagacucuccugucagggaagcaccuuucagaaggcccugcuuauuucuccucaucgguucggcgaggcuaaaggaaauuccgcuccccugaucauucgcgaaccuuuuaucgccugcgggccgaaggaguguauccacuucgcccucacgcauuacgcggcccagcccggcggguauuacaacggaaccagagaggaccggaauaaacugcgccaccugauuagcgucaaccucggcaagaucccuacaguggaaaauucuauuuuucauauggcugccugguccggcagcgcuugccacgaugggagagaguggaccuauaucggaguugacggccccgauucuaacgcccugauuaagaucaaauacggggaagcguacacagacaccuaucacuccuacgccaauaacauucuucggacgcaagagagcgcuuguaauugcaucggaggcgauuguuaucugaugaucacagacggguccgccucuggaauuagccgcugcagauuccucaagauccgggagggccgcauuaucaaagaaauuuuuccuaccggcagaguggagcauacagaagaguguaccugcggguucgcuuccaacaagaccaucgaaugugucugccgggauaauagcuacacagccaaacgccccuuugugaagcugaacguugagacggacaccgccgagaucagacuuaugugcacagaaaccuaucuggauacaccgcggccugacgauggaucuauuaccggccccugugaguccaauggggacaagggaaacggcgggaucaaaggaggcuucgugcaccagcgcauggcuagcagaauuggccggugguacucuagaacgaugagcaagacaaaacgcauggggauggaacucuaugucaaguacgacggagauccuuggaccgacuccgaugcgcuggcccccucuggcgugauggugagcauggaggaacccgggugguacuccuuuggauucgagaucaaagacaagaaaugcgaugucccuuguauuggcaucgagaugguucaugacgggggcaagaagaccuggcacagcgcugccacagccaucuauugccugaugggaucuggccagcuccugugggauaccgugacagggguggacauggcucuuuga

SEQ ID NO: 211602 - RNA, 1401 nt, Artificial Sequence
  derived and/or modified sequence opt5 from neuraminidase_glycoprotein__InfluenzaB__AAN39747
augcugcccagcaccauccagacacucauucuguuccuuacguccggcggggugcugcucucucuguacgucagcgcccuucuguccuaucuccuguacucugacauccugcucaaguuuagcccuaccaaaauuaucgcuccgacaaugucccuggauugcgccaacgcgucuaauguucaagcugugaaccacagcgccaccaaggagaugacauuccuucugcccgaaccugaguggaccuaucccagacucuccugucagggaagcacauuucagaaagcccugcuuauuucuccucaucgguucggcgaagcuaagggaaauuccgcuccccugaucauccgcgagccuuuuauugccugcgggccgaaagaauguaagcacuucgcccucacccauuacgcggcccagcccggcggguauuacaacggaacgagagaggaccggaauaagcugcgccaccugaucagcgugaaccucggcaaaauuccuaccgucgaaaauucuaucuuucauauggcugccugguccggcagcgcuugccacgaugggagagaguggacauauauuggaguggacggccccgauucuaacgcccugaucaagauuaaauacggggaggcguacaccgacacauaucacuccuacgccaauaacauccuucggacccaagaaagcgcuuguaauugcaucggaggcgauuguuaucugaugauuacggacggguccgccucuggaaucagcaagugccgcuuccucaaaauuagagagggccggaucauuaaggagaucuuuccuacaggccgcguugaacauaccgaggaauguacaugcggguucgcuuccaacaagaccaucgagugugccugcagagauaauagcuacaccgccaaacggcccuuugugaagcugaacgucgaaacagacacggcugagauucgccuuaugugcaccaaaacauaucuggauaccccgagaccugacgauggaucuaucacaggccccugugaguccaauggggacaagggaagcggcgggauuaaaggaggcuucgugcaccagcggauggcgucuaagaucggccgcugguacagcagaaccauguccaaaacgaagcggauggggauggaacucuauguuaaguacgacggagauccuuggacagacucugaugcccuggcucccagcggcgugauggucuccauugaggaacccgggugguacagcuuuggauucgagaucaaagacaagaaaugcgaugugccuuguaucggcauugaaauggugcaugacgggggcaagaaaaccuggcacucugccgccaccgcuaucuauugccugaugggauccggccagcuccugugggauacagucaccgggguugacauggcccuuuga

SEQ ID NO: 211603 - RNA, 1401 nt, Artificial Sequence
  derived and/or modified sequence opt5 from neuraminidase_glycoprotein__InfluenzaB__AAN39749
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauugcgccaacgcgucuaaugugcaagcugugaaccacagcgccacagaggaaaugaccuuccuucugcccgagccugaauggacauaucccagacucuccugucagggaagcaccuuucagaaggcccugcuuauuucuccucaucgguucggcgaggcuaaaggaaauuccgcuccccugaucauucgcgaaccuuuuaucgccugcgggccgaaggaguguaaacacuucgcccucacgcauuacgcggcccagcccggcggguauuacaacggaaccagagaggaccggaauaagcugcgccaccugaucagcgucaaccucggcaagauuccuacaguggaaaauucuaucuuucauauggcugccugguccggcagcgcuugccacgaugggagagaguggaccuauauuggaguugacggccccgauucuaacgcccugaucaaaauuaaguacggggaagcguacacagacaccuaucacuccuacgccaauaacauccuucggacgcaagagagcgcuuguaauugcauuggaggcgauuguuaucugaugaucacagacggguccgccucuggaaucagccgcugcagauuccucaaaauucgggagggccgcaucauuaaggaaaucuuuccuaccggcagaguggagcauacagaagaguguaccugcggguucgcuuccaacaaaaccauugaaugugccugccgggauaauagcuacacagccaagcgccccuuugucaagcugaacguggagacggacaccgcugagaucagacuuaugugcacagaaaccuaucuggauacaccgcggccugacgauggaucuaucaccggccccugugaguccaauggggacaaaggaaacggcgggauuaagggaggcuucguucaccagcgcauggcgagcagaaucggccggugguacucuagaacgaugagcaaaacaaagcgcauggggauggaacucuaugugaaauacgacggagauccuuggaccgacuccgaugcccuggcucccucuggcgucauggugagcauggaggaacccgggugguacuccuuuggauucgagauuaaggacaaaaagugcgaugugccuuguaucggcauugagaugguccaugacgggggcaagaaaaccuggcacagcgccgccacagcuaucuauugccugaugggaucuggccagcuccugugggauaccguuacagggguggacauggcccuuuga

SEQ ID NO: 211604 - RNA, 1401 nt, Artificial Sequence
  derived and/or modified sequence opt5 from neuraminidase_glycoprotein__InfluenzaB__AAN39751
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauugcgccaacgcgucuaaugugcaagcugugaaccacagcgccacagaggaaaugaccuuccuucugcccgagccugaauggacauaucccagacucuccugucagggaagcaccuuucagaaggcccugcuuauuucuccucaucgguucggcgaggcuaaaggaaauuccgcuccccugaucauucgcgaaccuuuuaucgccugcgggccgaaggaguguaaacacuucgcccucacgcauuacgcggcccagcccggcggguauuacaacggaaccagagaggaccggaauaagcugcgccaccugaucagcgucaaccucggcaagauuccuacaguggaaaauucuaucuuucauauggcugccugguccggcagcgcuugccacgaugggagagaguggaccuauauuggaguugacggccccgauucuaacgcccugaucaaaauuaaguacggggaagcguacacagacaccuaucacuccuacgccaauaacauccuucggacgcaagagagcgcuuguaauugcauuggaggcgauuguuaucugaugaucacagacggguccgccucuggaaucagccgcugcagauuccucaaaauucgggagggccgcauccugaaggaaauuuuuccuaccggcagaguggagcauacagaagaguguaccugcggguucgcuuccaacaaaaccaucgaaugugccugccgggauaauagcuacacagccaagcgccccuuuguccagcuuaacguggagacggacaccgcugagauuagacugaugugcacagaaaccuaucucgauacaccgcggccugacgauggaucuaucaccggccccugugaguccaauggggacaagggaaacggcgggaucaaaggaggcuucguucaccagcgcauggcgagcagaauuggccggugguacucuagaacgaugagcaagacaaaacgcauggggauggaccuguaugugaaguacgauggagacccuuggaccgauuccgacgcccuggcucccucuggcgucauggugagcauggaggaacccgggugguacuccuuuggauucgaaaucaaagauaagaaaugcgacgugccuuguauuggcaucgagaugguccaugaugggggcaagaagaccuggcacagcgccgccacagcuauuuauugccucaugggaucuggccagcugcuuugggacaccguuacagggguggauauggcccuguga

SEQ ID NO: 211605 - RNA, 1401 nt, Artificial Sequence
  derived and/or modified sequence opt5 from neuraminidase_glycoprotein__InfluenzaB__AAN39753
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauugcgccaacgcgucuaaugugcaagcugugaaccacagcgccacagaggaaaugaccuuccuucugcccgagccugaauggacauaucccagacucuccugucagggaagcaccuuucagaaggcccugcuuauuucuccucaucgguucggcgaggcuaaaggaaauuccgcuccccugaucauucgcgaaccuuuuaucgccugcgggccgaaggaguguaaacacuucgcccucacgcauuacgcggcccagcccggcgaguauuacaacgggaccagagaagaccggaauaagcugcgccaccugaucagcgucaaccucggaaagauuccuacaguggaaaauucuaucuuucauauggcugccugguccggcagcgcuugccacgauggcagagaauggaccuauauugggguugacggacccgauucuaacgcccugaucaaaauuaaguacggcgaggcguacacagacaccuaucacuccuacgccaauaacauccuucggacgcaagagagcgcuuguaauugcauugggggagauuguuaucugaugaucacagacggcuccgccucugggaucagccgcugcagauuccucaaaauucgggaaggacgcaucauuaaggagaucuuuccuaccggcagaguggaacauacagaggaauguaccugcggcuucgcuuccaacaaaaccauugagugugccugccgggauaauagcuacacagccaagcgccccuuugucaagcugaacguggagacggacaccgcugaaaucagacuuaugugcacagagaccuaucuggauacaccgcggccugacgaugggucuaucaccggacccugugaauccaauggcgacaaagggaacggaggcauuaaagggggauucguucaccagcgcauggcgagcagaaucggccggugguacucuagaacgaugagcaagacaaagcgcaugggcauggagcucuaugugaaauacgacggggauccuuggaccgacuccgaugcccuggcucccucuggagucauggugagcauggaggagcccggcugguacuccuuuggguucgagauuaaggacaaaaagugcgaugugccuuguaucggaauugaaaugguccaugacggcgggaagaaaaccuggcacagcgccgccacagcuaucuauugccugaugggcucuggacagcuccugugggauaccguuacaggcguggacauggcccuuuga

SEQ ID NO: 211606 - RNA, 1401 nt, Artificial Sequence
  derived and/or modified sequence opt5 from neuraminidase_glycoprotein__InfluenzaB__AAN39759
augcugcccagcaccauccagacacucacgcuguuccuuaccuccggcggggugcugcucucucuguacgucagcgccucccuuucuuaucugcucuacagcgacauucugcugaagcucuccccuacagagaucaccgcuccgacaaugccccuggauugcgccaacgcgucuaauguucaagcugugaacagaagcgccaccaaaggagugacacuucugcucccugaacccgaguggaccuauccucggcuguccugucccggcagcacguuucagaaggcccuucugauuucuccucaccgcuucggggaaaccaaaggaaauuccgcuccgcucaucauuagagagcccuuuaucgccugcggcccuaaggaauguaaacauuucgcucugacacacuacgccgcgcagcccgggggauauuacaacggcacccgggaggaccgcaauaagcugagacaucucaucagcgucaagcugggcaaaauuccuacaguggagaacucuaucuuucacauggccgcuugguccgggagcgccugccaugauggaaaggaauggaccuauauuggcguugacgggcccgauucuaaugcccuucugaaaaucaaguacggagaggcuuacacggacacauaucacuccuacgcgaacaauauucuccggacccaggaaagcgccuguaacugcaucggcgggaauuguuaucugaugauuacagauggauccgcuucuggcaucagcgagugccgcuuccuuaaaaucagagagggccggauuaucaaggaaauuuuuccgaccgggcgcgugaagcacaccgaggaauguacaugcggauucgccuccaacaaaacgaucgagugugcuugcagagacaauagcuacaccgccaagcggccuuuugucaaacugaacguggaaacagauaccgccgagauucgccucaugugcacagagaccuaucuggacacgcccagaccugaugacggcucuaucacagggcccugugaauccaauggagauaagggcagcgggggaaucaaaggcggcuucguucaucaacggauggagucuaagauugggcgcugguacagcagaaccauguccaaaaccaagcggaugggaaugggccuguaugugaaguacgacggggaccccuggacagauucugacgcucucgcgcugagcggagucaugguguccaucgaggaaccuggcugguacagcuuuggguucgaaauuaaagauaagaaaugcgacgugccguguaucggcauugagaugguccacgauggaggcaaggagaccuggcauucugccgcuacagccaucuauugccuuaugggguccggacagcugcucugggacacgguuaccggcguggauauggcccuguga

SEQ ID NO: 211607 - RNA, 1401 nt, Artificial Sequence
  derived and/or modified sequence opt5 from neuraminidase_glycoprotein__InfluenzaB__AAN39761
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaaggaauguaaacauuuugcucucacacacuacgccgcgcagccugggggauauuacaacggcacccgggaggaccgcaauaagcugagacaucugaucagcgucaagcucggcaaaauucccacaguggagaacucuaucuuccacauggccgcuugguccgggagcgccugccaugauggacgggaauggaccuauauuggcguugacgggccugauucuaaugcucugcuuaagaucaaauacggagaggccuacacggacacauaucacuccuacgcgaagaacauucugcgcacccaagaaagcgccuguaauugcaucggcggggauuguuaucucaugauuacagacggauccgcuucuggcaucagcgagugcagauuucugaaaauccgggagggccgcauuaucaaggaaauuuuccccaccgggagaaucaagcacaccgaggaauguacaugcggauuugccuccaacaaaacgauugagugugcuugccgggauaauagcuacaccgccaagcgcccguucgugaaacuuaacgucgaaacagacaccgccgagaucagacugaugugcacagagaccuaucucgauacgccucggcccgacgauggcucuaucacagggccuugugaauccaauggagacaagggcagcgggggaauuaaaggcggcuuugugcaucagcgcauggcuucuaagaucgggagaugguacagccggaccauguccaaaaccaagagaaugggaaugggccuguauguuaaguacgacggggaucccuggacagacucugaggcgcuggcccucagcggagugauggucuccauggaggaacccggcugguacagcuucggguuugaaauuaaagauaagaaaugcgacgugccuuguaucggcauugagauggugcacgauggaggcaagaccacauggcauucugcugccacggccaucuauugccugaugggguccggacagcuucugugggacaccgucacaggcguugauauggcucucuga

SEQ ID NO: 211608 - RNA, 1401 nt, Artificial Sequence
  derived and/or modified sequence opt5 from neuraminidase_glycoprotein__InfluenzaB__AAN39769
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggagagaauggacauauaucggagucgacggccccgauuccaacgcccugauuaagaucaaauacggggaggcguacaccgacacguaucacagcuacgccaauaacauucuucggacacaagaauccgcuugcaauuguaucggaggcgauugcuaucugaugaucaccgacgggucugccagcggaauuuccaagugucgcuuucucaaaaucagagagggccggauuaucaaggagauuuucccuacaggccgcguggaacauaccgaggaaugcaccuguggguuugcuagcaacaagacaaucgagugcgccuguagagauaauucuuacacggccaaacggcccuucguuaagcugaacguggaaaccgacacagcugagauccgccuuaugugcaccgagacauaucuggauaccccgagaccugacgauggauccauuacgggccccugcgaaagcaauggggacaaaggaucuggcgggaucaagggaggcuuuguccaccagcggauggcgagcaaaauuggccgcugguacuccagaacaaugucuaagaccaaacggauggggauggagcucuaugugaaguacgacggagauccuuggaccgacagcgaugcccuggcucccuccggcguuauggugagcaucgaggagcccgggugguacucuuucggauucgaaauuaaggacaaaaagugugaugucccuugcaucggcaucgagauggugcaugacgggggcaaaacaaccuggcacuccgccgccacagcuauuuauugucugaugggaagcggccagcuccugugggauacggugaccggggucgacauggcccuuuga

SEQ ID NO: 211609 - RNA, 1401 nt, Artificial Sequence
  derived and/or modified sequence opt5 from neuraminidase_glycoprotein__InfluenzaB__AAN39771
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggagagaauggacauauaucggagucgacggccccgauuccaacgcccugauuaagaucaaauacggggaggcguacaccgacacguaucacagcuacgccaauaacauucuucggacacaagaauccgcuugcaauuguaucggaggcgauugcuaucugaugaucaccgacgggucugccagcggaauuuccaagugucgcuuucucaaaaucagagagggccggauugugaaggagaucuucccuacaggccgcguugaacauaccgaggaaugcaccuguggguuugcuagcaacaagacaauugagugcgccuguagagauaauucuuacacggccaaacggcccuucgugaagcugaacgucgaaaccgacacagcugagauccgccuuaugugcaccgagacauaucuggauaccccgagaccugacgauggauccaucacgggccccugcgaaagcaauggggacaaaggaucuggcgggauuaagggaggcuuugugcaccagcggauggcgagcaaaaucggccgcugguacuccagaacaaugucuaagaccaaacggauggggauggagcucuauguuaaguacgacggagauccuuggaccgacagcgaugcccuggaccccuccggcgugauggucagcauugaggagcccgggugguacucuuucggauucgaaaucaaggauaaaaagugugacgugccuugcauuggcaucgagauggugcaugaugggggcaaaacaaccuggcacuccgcugccacagccaucuauugucugaugggaagcggccagcuccugugggacacgauuaccggggucgauauggcucuuuga

SEQ ID NO: 211610 - RNA, 1401 nt, Artificial Sequence
  derived and/or modified sequence opt5 from neuraminidase_glycoprotein__InfluenzaB__AAN39773
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaacuucggcaaaaucccuaccguggaaaauuccauuuuucauauggcugccuggagcggcucugcuugucacgaugggagagaauggacauauaucggagucgacggccccgauuccaacgcccucauuaagaucaaauacggggaggcguacaccgacacguaucacagcuacgccaauaacauucugcggacacaagaauccgcuugcaauuguaucggaggcgauugcuaucuuaugaucaccgacgggucugccagcggaauuuccaagugucgcuuccugaaaaucagagagggccggauugugaaggagaucuuuccuacaggccgcguugaacauaccgaggaaugcaccuguggguucgcuagcaacaagacaauugagugcgccuguagagauaauucuuacacggccaaacggcccuuugugaagcucaacgucgaaaccgacacagcugagauccgccugaugugcaccgagacauaucuugauaccccgagaccugacgauggauccaucacgggccccugcgaaagcaauggggacaaaggaucuggcgggauuaagggaggcuucgugcaccagcggauggcgagcaaaaucggccgcugguacuccagaacaaugucuaagaccaaacggauggggauggagcuguauguuaaguacgacggagauccuuggaccgacagcgaugcccucgcucccuccggcgugauggucagcauugaggagcccgggugguacucuuucggauuugaaaucaaggacaaaaagugugaugugccuugcauuggcaucgagauggugcaugacgggggcaaaacaaccuggcacuccgccgccacagcuaucuauugucugaugggaagcggccagcugcucugggauacgauuaccggggucgacauggcccuguga

SEQ ID NO: 211611 - RNA, 1401 nt, Artificial Sequence
  derived and/or modified sequence opt5 from neuraminidase_glycoprotein__InfluenzaB__AAN39775
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggaaggaauggacauauaucggagucgacggccccgauuccaacgcccugauuaaaaucaaguacggggaggcguacaccgacacguaucacagcuacgccaauaacauucuuagaacacaagaauccgcuugcaauuguaucggaggcgauugcuaucugaugaucaccgacgggucugccagcggaauuuccaaaugucgguuucucaagauccgcgagggcagaauuaucaaggagauuuucccuacaggccggguggaacauaccgaggaaugcaccuguggguuugcuagcaacaaaacaaucgagugcgccugucgcgauaauucuuacacggccaagagacccuucguuaaacugaacguggaaaccgacacagcugagauccggcuuaugugcaccgagacauaucuggauaccccgcgcccugacgauggauccauuacgggccccugcgaaagcaauggggacaagggaucuggcgggaucaaaggaggcuuuguccaccagagaauggcgagcaagauuggccggugguacucccgcacaaugucuaaaaccaagagaauggggauggagcucuaugugaaguacgacggagauccuuggaccgacagcgaugcccuggcucccuccggcguuauggugagcaucgaggagcccgggugguacucuuucggauucgaaauuaaagacaagaaaugugaugucccuugcaucggcaucgagauggugcaugacgggggcaagacaaccuggcacuccgccgccacagcuauuuauugucugaugggaagcggccagcuccugugggauacggugaccggggucgacauggcccuuuga

SEQ ID NO: 211612 - RNA, 1401 nt, Artificial Sequence
  derived and/or modified sequence opt5 from neuraminidase_glycoprotein__InfluenzaB__AAN39777
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucccccugaacccgaguggaccuauccucggcuguccugucccggcagcacguuccagaaggcccuccugauuucuccucaccgcuuuggggaaaccaaaggaaauuccgcuccgcuuaucauuagagagcccuucaucgccugcggcccuaaggaauguaaacauuuugcucugacacacuacgccgcgcagcccgggggauauuacaacggcacccgggaggaccgcaauaagcucagacaucugaucagcgucaagcugggcaaaauuccuacaguggagaacucuaucuuccacauggccgcuugguccgggagcgccugccaugauggacgggaauggaccuauauuggcguugacgggcccgauucuaaugcucuccugaagaucaaauacggagaggccuacacggacacauaucacuccuacgcgaagaacauucuucgcacccaagaaagcgccuguaauugcaucggcggggauuguuaucugaugauuacagacggauccgcuucuggcaucagcgagugcagauuucucaaaauccgggagggccgcauuaucaaggaaauuuucccgaccgggagagugaagcacaccgaggaauguacaugcggauuugccuccaacaaaacgaucgagugugcuugccgggauaauagcuacaccgccaagcgcccuuucgucaaacugaacguggaaacagacaccgccgagauuagacuuaugugcacagagaccuaucuggauacgccccggccugacgauggcucuaucacagggcccugugaauccaauggaaacaagggcagcgggggaaucaaaggcggcuuuguucaucagcgcauggcuucuaagauugggagaugguacagccggaccauguccaaaaccaagagaaugggaaugggccucuaugugaaguacgacggggaccccuggacagauucugaggcgcuggcccugagcggagucaugguguccauggaggaaccuggcugguacagcuucggguuugaaaucaaagacaagaaaugcgaugugccguguauuggcaucgagaugguccacgacggaggcaagaccacauggcauucugcugccacggccauuuauugccucaugggguccggacagcugcuuugggauaccguuacaggcguggacauggcucuguga

SEQ ID NO: 211613 - RNA, 1401 nt, Artificial Sequence; identical to SEQ ID NO: 211608
  derived and/or modified sequence opt5 from neuraminidase_glycoprotein__InfluenzaB__AAN39779

SEQ ID NO: 211614 - RNA, 1401 nt, Artificial Sequence
  derived and/or modified sequence opt5 from neuraminidase_glycoprotein__InfluenzaB__AAN39781
augcugcccagcaccauccagacacucacgcuguuccuuaccuccggcggggugcugcucucucuguacgucagcgccucccuuucuuaucugcucuacagcgacauucugcugaaguuuuccucuacagagaucaccgcuccuacaaugccgcucaacugcgccaaugcgagcaacguucaagcugugaaucacuccgccaccaaaggagugacacugccccuuccugaacccgaguggaccuauccuagacugagcugucccggcucuacguuccagaaggcccuccugauuuccccucaucgguuuggggaaaccaaaggaaacagcgcuccgcuuaucauucgcgagcccuucaucgccugcggcccuaaggaauguaaacacuuugcucugacacauuacgccgcgcagcccgggggauauuacaauggcaccagagaggaucggaacaagcuccgccaccugaucucugucaagcugggcaaaauuccuacaguggaaaauuccaucuuccauauggccgcuuggagcgggucugccugccacgacggaagagaauggaccuauauuggcguugaugggcccgacuccaacgcucuccugaagaucaaauacggagaggccuacacggauacauaucacagcuacgcgaauaacauucuucggacccaggaauccgccuguaauugcaucggcggggacuguuaucugaugauuacagauggaucugcuagcggcguguccgagugccgcuuucucaagaucagagagggccggaucauuaaagaaaucuucccgaccgggcgcgucgagcauaccgaagaguguacaugcggauuugccagcaacaagacgauugaaugugcuugcagagacaauucuuacaccgccaagcggccuuucgugaaacugaacguugagacagauaccgccgagauccgccuuaugugcacagaaaccuaucuggacacgcccagaccugaugacggcuccauuacagggcccugugagagcaauggagauaagggcucugggggaaucaaaggcggcuuugugcaccaacggauggcuagcaagaucgggcgcugguacuccagaaccaugucuaaaaacaagcggaugggaaugggccucuaugucaaauacgacggggaccccuggauugauagcgacgcgcugacccuguccggagugauggugagcauggaggagccuggcugguacucuuucggguuugaaaucaaggauaagaaaugcgacgucccguguauuggcaucgagaugguucaugauggaggcaaggagacauggcacuccgccgcuaccgccauuuauugccucauggggagcggacagcugcuuugggacacagugacgggcgugaacauggcccuguga

SEQ ID NO: 211615 - RNA, 1401 nt, Artificial Sequence
  derived and/or modified sequence opt5 from neuraminidase_glycoprotein__InfluenzaB__AAN39783
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaaggaauguaaacauuuugcucucacacacuacgccgcgcagccugggggauauuacaacggcacccgggaggaccgcaauaagcugagacaucugaucagcgucaagcucggcaaaauucccacaguggagaacucuaucuuccacauggccgcuugguccgggagcgccugccaugauggacgggaauggaccuauauuggcguugacgggccugauucuaaugcucugcuuaagaucaaauacggagaggccuacacggacacauaucacuccuacgcgaagaacauucugcgcacccaagaaagcgccuguaauugcaucggcggggauuguuaucucaugauuacagacggauccgcuucuggcaucagcgagugcagauuucugaaaauccgggagggccgcauuaucaaggaaauuuuccccaccgggagagugaagcacaccgaggaauguacaugcggauuugccuccaacaaaacgaucgagugugcuugccgggauaauagcuacaccgccaagcgcccguucgucaaacuuaacguggaaacagacaccgccgagauuagacugaugugcacagagaccuaucucgauacgccucggcccaaugacggcucuaucacagggccuugugaauccaacggagauaagggcagcgggggaaucaaaggcggcuuuguucaucagcgcauggcuucuaagauugggagaugguacagccggaccauguccaaaaccaagagaaugggaaugggccuguaugugaaguacgacggggaccccuggacagauucugaggcgcuggcccucagcggagucaugguguccauggaggaacccggcugguacagcuucggguuugaaaucaaagacaagaaaugcgaugugccuuguauuggcaucgagaugguccacgacggaggcaagaccacauggcauucugcugccacggccauuuauugccugaugggguccggacagcuucugugggauaccguuacaggcguggacauggcucucuga

SEQ ID NO: 211616 - RNA, 1401 nt, Artificial Sequence
  derived and/or modified sequence opt5 from neuraminidase_glycoprotein__InfluenzaB__AAN39785
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauuaugccaacgcgucuaaugugcaagcugugaaccacagcgccacagaggaaaugaccuuccuucugcccgagccugaauggacauaccccagacucuccugccagggaagcaccuuucagaaggcccugcuuauuucuccucaucgguucggcgaggcuaaaggaaauuccgcuccccugaucauucgcgaaccuuuuaucgccugugggccgaaggagugcaaacacuucgcccucacgcauuaugcggcccagcccggcggguacuauaacggaaccagagaggaccggaauaagcugcgccaccugaucagcgucaaccucggcaagauuccuacaguggaaaauucuaucuuucauauggcugccugguccggcagcgcuugucacgaugggagagaguggaccuacauuggaguugacggccccgauucuaacgcccugaucaaaauuaaguacggggaagcguauacagacaccuaccacuccuaugccaauaacauccuucggacgcaagagagcgcuugcaauuguauuggaggcgauugcuaccugaugaucacagacggguccgccucuggaaucagccgcuguagauuccucaaaauucgggagggccgcaucauuaaggaaaucuuuccuaccggcagaguggagcauacagaagagugcaccuguggguucgcuuccaacaaaaccauugaaugcgccugucgggauaauagcuauacagccaagcgccccuuugucaagcugaacguggagacggacaccgcugagaucagacuuaugugcacagaaaccuaccuggauacaccgcggccugacgauggaucuaucaccggccccugcgaguccaauggggacaaaggaagcggcgggauuaagggaggcuucguucaccagcgcaugacgucuagaaucggccggugguauagcagaacaauguccaaaaccaagcgcauggggauggaacucuacgugaaauacgacggagauccuuggaccgacucugaugcgcuggcccccagcggcgucaugguguccauggaggaacccgggugguauagcuuuggauucgagauuaaggacaaaaagugugaugugccuugcaucggcauugagaugguccaugacgggggcaagaaaacauggcacucugcugccaccgccaucuacugucugaugggauccggccagcuccugugggauacaguuacggggguggacauggcucuuuga

SEQ ID NO: 211617 - RNA, 1401 nt, Artificial Sequence
  derived and/or modified sequence opt5 from neuraminidase_glycoprotein__InfluenzaB__AAN39787
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauuaugccaacgcgucuaaugugcaagcugugaaccacagcgccacagaggaaaugaccuuccuucugcccgagccugaauggacauaccccagacucuccugccagggaagcaccuuucagaaggcccugcuuauuucuccucaucgguucggcgaggcuaaaggaaauuccgcuccccugaucauucgcgaaccuuuuaucgccugugggccgaaggagugcaaacacuucgcccucacgcauuaugcggcccagcccggcggguacuauaacggaaccagagaggaccggaauaagcugcgccaccugaucagcgucaaccucggcaagauuccuacaguggaaaauucuaucuuucauauggcugccugguccggcagcgcuugucacgaugggagagaguggaccuacauuggaguugacggccccgauucuaacgcccugaucaaaauuaaguacggggaagcguauacagacaccuaccacuccuaugccaauaacauccuucggacgcaagagagcgcuugcaauuguauuggaggcgauugcuaccugaugaucacagacggguccgccucuggaaucagccgcuguagauuccucaaaauucgggagggccgcaucauuaaggaaaucuuuccuaccggcagaguggagcauacagaagagugcaccuguggguucgcuuccaacaaaaccauugaaugcgccugucgggauaauagcuauacagccaagcgccccuuugucaagcugaacguggagacggacaccgcugagaucagacuuaugugcacagaaaccuaccuggauacaccgcggccugacgauggaucuaucaccggccccugcgaguccaauggggacaaaggaaacggcgggauuaagggaggcuucguucaccagcgcauggcgagcagaaucggccggugguauucuagaacgaugagcaaaacaaagcgcauggggauggaacucuacgugaaauacgacggagauccuuggaccgacuccgaugcccuggcucccucuggcgucauggugagcauggaggaacccgggugguauuccuuuggauucgagauuaaggacaaaaagugugaugugccuugcaucggcauugagaugguccaugacgggggcaagaaaaccuggcacagcgccgccacagcuaucuacugucugaugggaucuggccagcuccugugggauaccguuacagggguggacauggcccuuuga

SEQ ID NO: 211618 - RNA, 1401 nt, Artificial Sequence
  derived and/or modified sequence opt5 from neuraminidase_glycoprotein__InfluenzaB__AAN39795
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccagaggaaauuccgcuccgcugaucauucgggagcccuucaucgccugcggcccuaaagaauguaagcauuuugcucucacacacuacgccgcgcagcccgggggauauuacaacggcacccgcgaggacagaaauaaacugcggcaucugaucagcgucaagcucggcaagauuccuacaguggagaacucuaucuuccacauggccgcuugguccgggagcgccugccaugauggacgcgaauggaccuauauuggcguugacgggcccgauucuaaugcucugcuuaaaaucaaguacggagaggccuacacggacacauaucacuccuacgcgaacaauauucugagaacccaggaaagcgccuguaacugcaucggcggggauuguuaucucaugauuacagacggauccgcuucuggcaccagcaaaugccgguuucugaagauccgcgagggcagaaucauuaaagagaucuucccgaccgggcggguggaacacacagaggaauguacgugcggauuugccuccaauaagaccauugagugugcuugccgcgauaacaauuacacagccaagagaccuuucgucaaacuuaacguggaaaccgacgccgcugagauccggcugaugugcacagagaccuaucucgauacgccccgcccugacgauggcagcauuacagggcccugugaaucuaauggagacaagggcagagggggaaucaaaggcggcuuuguucaucaacggauggcguccaagaucgggagaugguacagccgcaccaugucuaaaaccgagcggaugggaauggaacuguaugugaaguacgacggcgaucccuggacagacagcgaugcccuggcucucuccggggucauggugucuauggaggaaccuggaugguacagcuucggcuuugagauuaaagacaagaagugcgaugugccguguaucgggauugagaugguccacgacggcggcaaaaagaccuggcauuccgccgccacagcuaucuauugccugaugggaagcgggcagcuucugugggauacgguuaccggaguggacauggcccucuga

SEQ ID NO: 211619 - RNA, 1401 nt, Artificial Sequence; identical to SEQ ID NO: 211603
  derived and/or modified sequence opt5 from neuraminidase_glycoprotein__InfluenzaB__AAN39797

SEQ ID NO: 211620 - RNA, 1401 nt, Artificial Sequence
  derived and/or modified sequence opt5 from neuraminidase_glycoprotein__InfluenzaB__AAN39799
augcugcccagcaccauccagacacucacgcuguuccuuaccuccggcggggugcugcucucucuguacgucagcgcccuucuguccuaucuccuguacucugacguucugcucaaguuuagcccuacaaaaauuaucgcuccgaccaugucccuggauugcgccaacgcgucuaaugugcaagcugugaaccacagcgccacagaggaaaugaccuuccuucugcccgagccugaauggacauaucccagacucuccugucagggaagcaccuuucagaaggcccugcuuauuucuccucaucgguucggcgaggcuaaaggaaauuccgcuccccugaucauucgcgaaccuuuuaucgccugcgggccgaaggaguguaaacacuucgcccucacgcauuacgcggcccagcccggcggguauuacaacggaaccagagaggaccggaauaagcugcgccaccugaucagcgucaaccucggcaagauuccuacaguggaaaauucuaucuuucauauggcugccugguccggcagcgcuugccacgaugggagagaguggaccuauauuggaguugacggccccgauucuaacgcccugaucaaaauugaauacggggaggcguacacagacaccuaucacuccuacgccuauaauauccuucggacgcaagagagcgcuuguaacugcauuggaggcgauuguuaccugaugaucacagacggguccgccucuggaaucagcaagugccgcuuccucaaaauuagagaaggccggaucauuaaggagaucuuuccuaccggccgcguggaacauacagaggaauguaccugcggguucgcuuccaauaaaaccauugagugugccugcagagauaacagcuauacagccaagcggcccuuugucaagcugaauguggagacggacaccgcugaaauccgccuuaugugcacagagaccuaccuggauacaccgagaccugacgauggaucuaucaccggccccugugaauccaacggggacaaaggaagcggcgggauuaagggaggcuucguucaccagcggauggcgucuaaaaucggccgcugguauagcagaacgauguccaagacaaaacggauggggauggagcucuacgugaaguacgacggagauccuuggaccgacucugaugcccuggcucccagcggcgucaugguguccauggaggaacccgggugguauagcuuuggauucgagauuaaagacaagaagugcgaugugccuuguaucggcauugaaaugguccaugacgggggcaaaaagaccuggcacucugccgccacagcuaucuacugccugaugggauccggccagcuccugugggauaccguuacagggguggacauggcccuuuga

SEQ ID NO: 211621 - RNA, 1401 nt, Artificial Sequence
  derived and/or modified sequence opt5 from neuraminidase_glycoprotein__InfluenzaB__AAN39801
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaaugcucaagccguuaacagaagcgccaccaaaggagugacacugcuucugccugaacccgaguggaccuauccucggcucuccugucccggcagcacguuccagaaggcucugcuuauuucuccucaccgcuuuggggaaaccaaaggaaauuccgccccgcugaucauuagagagcccuucaucgcuugcggcccuaaggaauguaaacauuuugcccucacacacuacgcggcccagcccgggggauauuacaacggcacccgggaggaccgcaauaagcugagacaucugaucagcgugaagcucggcaaaauuccuacagucgagaacucuaucuuccacauggcugccugguccgggagcgcuugccaugauggaaaggaauggaccuauauuggcguggacgggcccgauucuaaugcccugcuuaaaaucaaguacggagaggcguacacggacacauaucacuccuacgccaacaauauucugcggacccaggaaagcgcuuguaacugcaucggcgggaauuguuaucucaugauuacagauggauccgccucuggcaucagcgagugccgcuuucugaaaaucagagagggccggauuaucaaggaaauuuucccgaccgggcgcguuaagcacaccgaggaauguacaugcggauuugcuuccaacaaaacgaucgagugugccugcagagacaauagcuacaccgccaagcggccuuucgugaaacuuaacgucgaaacagauaccgcugagauucgccugaugugcacagagaccuaucucgacacgcccagaccugaugacggcucuaucacagggcccugugaauccaauggagauaagggcagcgggggaaucaaaggcggcuuugugcaucaacggauggcgucuaagauugggcgcugguacagcagaaccauguccaaaaccaagcggaugggaaugggccuguauguuaaguacgacggggaccccuggacagauucugacgcccuggcucucagcggagugauggucuccauggaggaaccuggcugguacagcuucggguuugagaucaaagauaagaaaugcgacgugccguguauuggcaucgaaauggugcacgauggaggcaaggagaccuggcauucugccgccacagcuauuuauugccugaugggguccggacagcuucugugggacacggucaccggcguugauauggcccucuga

SEQ ID NO: 211622 - RNA, 1401 nt, Artificial Sequence
  derived and/or modified sequence opt5 from neuraminidase_glycoprotein__InfluenzaB__AAN39803
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgaaaguuccccucgauugcgccaacgcgucuaaugugcaagcugugaacagaagcgccacaaagggaaugacccugcuucuguccgaaccugaguggacauauccccggcucagcugucagggcucuaccuuccagaaagcccugcuuauuuccccucaccgcuuuggggaaacgagaggaaauagcgcuccccugaucauucgggagccuuucaucgccugcggcccgaaggaauguaaacauuuugcucucacccacuacgccgcgcagcccgggggauauuacaacggcacacgcgaggacagaaauaagcugcggcaucugaucucugucaagcucggcaaaauuccuaccguggagaacuccaucuuccacauggccgcuuggagcgggucugccugccaugauggacgcgaauggacauauauuggccuggacgggcccgauuccaaugcucuuaucaagauuaaauacggagaggccuacaccgacacguaucacagcuacgcgaacaauauccugagaacacaagaauccgccuguaacugcauuggcggggauuguuaucucaugaucaccgacggaucugcuagcggcaucuccaagugccgguuucugaaaauucgcgagggcagaaucauuaaggagaucuucccuacagggcggguugaacacaccgaggaauguaccugcggauuugccagcaauaagacaauugagugugcuugccgcgauaacucuuacacggccaaaagacccuucgugaaacuuaaugucgaaaccgacacagccgagauccggcugaugugcaccgagacauaucucgauaccccgcgcccugacgauggcuccaucacggggcccugugaaagcaacggagacaagggcagagggggaauuaagggcggcuuugugcaucagcggauggcuucuaaaaucgggagaugguacagccgcacaauguccaagaccgagcggaugggaauggaacuguauguuaaauacgacggcgauccuuggaccgacucugaugcgcuggcccccagcggggugauggucuccaugaaggagcccggaugguacagcuucggcuuugaaauuaaggacaaaaagugcgaugugccuuguaucgggauugagauggugcacgacggcggaaaagagacauggcauucugcugccaccgccaucuauugccucaugggcuccgggcagcugcuuugggauacagucacgggaguugacauggcucuguga

SEQ ID NO: 211623 - RNA, 1401 nt, Artificial Sequence
  derived and/or modified sequence opt5 from neuraminidase__InfluenzaB__ABA02232
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgaaaauaacgcucugcuuaaaaucaaguacggcgaggccuacacggauacauaucacucuuacgcgaauaacauucugcggacccaggaauccgccuguaauugcaucgggggaaacuguuaucucaugauuacagacggcagcgcuuccggcaucucugagugccgcuuucugaaaaucagagaggggcggauuaucaaggaaauuuucccgaccggacgcgugaagcacaccgaggaauguacaugcggcuuugccagcaauaaaacgaucgagugugcuugcagagauaacuccuacaccgccaagcggccuuucgucaaacuuaauguggaaacagacaccgccgagauucgccugaugugcacagagaccuaucucgauacgcccagaccugacgaugggagcaucacaggacccugugaaucuaacggcgacaagggguccggaggcaucaaaggcggguuuguucaucaacggauggcuagcaagauuggacgcugguacucuagaaccaugagcaaaaccaagcggaugggcauggggcuguaugugaaguacgauggagaccccuggacagacuccgaugcgcuggcccucucuggcgucauggugagcauggaggaaccugggugguacuccuucggcuuugagaucaaagacaagaaaugcgaugugccguguauuggaaucgaaaugguccacgacggcgggaaggagaccuggcauagcgcugccacagccauuuauugccugaugggaucuggccagcuucugugggauacgguuaccgggguggacauggcucucuga

SEQ ID NO: 211624 - RNA, 1401 nt, Artificial Sequence
  derived and/or modified sequence opt5 from neuraminidase__InfluenzaB__ABI84039
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaaguacaccgaagaguguacaugcggcuuugccagcaacaagacgauugaaugugcuugcagagacaauuccuauaccgccaaacggccuuucgugaaacuuaacguugagacagauaccgccgaaauccgccugaugugcacagacaccuaccucgauacgcccagaccugacgaugggagcauuacaggacccugugagucuaacggcgacaagggguccggaggcaucaagggcggguuugugcaccaacggauggcuagcaaaaucggacgcugguauucuagaaccaugagcaagaccgagcggaugggcauggggcuguacgucaaauacgacggagaucccugggcggacuccgaugcccuggcuuucucuggcgugauggugagcaugaaggaaccugggugguauuccuuuggcuucgagauuaaggacaaaaagugcgaugucccguguaucggaauugaaaugguucaugacggcgggaaagagacauggcacagcgccgccaccgcuaucuacugccucaugggaucuggccagcugcuuugggauacagugacggggguggacauggcccuguga

SEQ ID NO: 211625 - RNA, 1401 nt, Artificial Sequence
  derived and/or modified sequence opt5 from neuraminidase__InfluenzaB__ABI84051
augcugcccagcaccauccagacacucacgcuguuccuuaccuccggcggggugcugcucucucuguacgucagcgccucccuuucuuaucugcucuacagcgacauucugcugagauuuucccaaacagagaucaccgcuccuauuaugccgcucgauugcgccaacgcgucuaauguucaggcugugaaccacagcgccacaaagggagugacccugcuucugcccgaaccugaguggacauauccccggcucuccuguccuggcagcaccuuccagaaagcccugcuuaucucuccccaucgcuuuggggaaacgaagggaaauuccgcuccucugauuaucagagagccguucaucgccugcggccccaaagaauguaagcacuuugcucucacccauuacgccgcgcagccugggggauauuacaacggcacacgggaggaccgcaauaaacugagacaccugauuagcgucaagcucggcaagauccccaccguggagaacucuauuuuccauauggccgcuugguccgggagcgccugccacgauggacgggaauggacauauaucggcguugacgggccugauucuaaugcucugcuuaaaauuaaguacggagaggccuacaccgacacguaucacuccuacgcgaaaaacauccugcgcacacaagaaagcgccuguaauugcauuggcggggauuguuaucucaugaucaccgacggacccgcuuccggcaucucugagugcagauuucugaagauucgggagggccgcaucauuaaagaaaucuucccgacagggagagugaagcauaccgaggaauguaccugcggauuugccagcaacaagacaauugagugugcuugccgggauaauuccuacacggccaaacgcccuuucgucaaacuuaacguggaaaccgacacagccgagaucagacugaugugcaccgagacauaucucgauacgccccggccuaaugacggcagcaucaccgggcccugugaaucuaacggagauaagggcuccgggggaauuaagggcggcuuuguucaccagcgcauggcuagcaaaaucgggagaugguacucucggacaaugagcaagaccaaaagaaugggaaugggccuguaugugaaguacgacggggaccccuggaccgauuccgaggcgcuggcccucucuggagucauggugagcauggaggaaccuggcugguacuccuucggguuugaaauuaaggacaaaaagugcgaugugccguguaucggcauugagaugguccaugacggaggcaaaacaaccuggcacagcgcugccacagccaucuauugccugauggggucuggacagcuucugugggauacgguuaccggcguggacauggcucucuga

SEQ ID NO: 211626 - RNA, 1401 nt, Artificial Sequence
  derived and/or modified sequence opt5 from neuraminidase__InfluenzaB__ABI84062
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaucaugccccucgauugcgccaacgcgucuaauguucaagcugugaacagaagcaccacaaaaggagugacccugcuucugccugaacccgaguggacauauccucggcucuccugucccggcagcaccuuccagaaggcccugcuuauuucuccucaccgcuuuggggaaacgaaaggaaauuccgccccgcugaucaucagagagcccuucauugcuugcggcccuaaggaauguaaacauuuugcccucacccacuacgcugcccagcccgggggauauuacaacggcacacggggcgaccgcaauaagcugagacaucugaucagcgucaagcucgggaaaauuccuaccguggagaacucuaucuuccacauggcggccugguccggaagcgcuugccaugauggcaaggaguggacauauauugggguugacggacccgauaauaacgcccugcuuaaaaucaaguacggcgaggcuuacaccgacacguaucacucuuacgccaauaacauucugcggacacaggaauccgcguguaauugcaucgggggaaacuguuaucucaugaucaccgauggcccggccagcggcauuuccgaaugccgcuuucugaaaaucagagaggggcggauuaucaaggagauuuucccuacaggacgcgugaagcacaccgaagaguguaccugcggcuuugcuucuaauaaaacaaucgaaugugccugcagagacaacagcuacacggcuaagcggcccuucgucaaacuuaauguggagaccgauacagccgaaauccgccugaugugcaccgagacauaucucgacaccccuagacccgaugacggguccauuacgggacccugugagagcaacggcgauaaggggucuggaggcaucaaaggcggguuuguucaucaacggauggccuccaagauuggacgcugguacagcagaacaaugucuaaaaccgaacggaugggcauggggcuguaugugaaguacgacggagacccuugggcugauagcgacgcgcuggcccucuccggcgucauggugucuauggaggaaccggggugguacagcuucggcuuugagaucaaggauaaaaagugcgacgugcccuguauuggaaucgaaaugguccacgauggcgggaaagagaccuggcauuccgcugccacagccaucuauugccugaugggaagcggccagcuucugugggacaccguuacagggguggauauggcucucuga

SEQ ID NO: 211627 - RNA, 1401 nt, Artificial Sequence
  derived and/or modified sequence opt5 from neuraminidase__InfluenzaB__ABL76280
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucaacugcgccaaugcgucuaacguucaagcugugaauagaagcgccaccaaaggagugacacugcuucugccugaacccgaguggaccuauccucggcucuccugucccggcagcacguuccagaaggcccugcuuauuucuccucaccgcuuuggggaaaccaaaggaaacuccgcuccgcugaucauuagagagcccuucaucgccugcggcccuaaggaauguaaacauuuugcucucacacacuacgccgcgcagcccgggggauauuacaauggcacccgggaggaucgcaacaagcugagacaucugaucagcgucaagcucggcaaaauuccuacaguggaaaauucuaucuuccacauggccgcuugguccgggagcgccugccaugacggacgggaauggaccuauauuggcguugaugggcccgacucuaacgcucugcuuaagaucaaauacggagaggccuacacggauacauaucacuccuacgcgaauaacauucugcgcacccaggaaagcgccuguaauugcaucggcggggacuguuaucucaugauuacagauggauccgcuucuggcaucagcgagugcagauuucugaagauccgggagggccgcauuaucaaagaaauuuucccgaccgggagaguggagcacaccgaagaguguacaugcggauuugccuccaacaagacgaucgaaugugcuugccgggacaauagcuacaccgccaagcgcccuuucgucaaacuuaacguggagacagauaccgccgagauuagacugaugugcacagaaaccuaucucgacacgccccggccugaugacggcucuaucacagggcccugugaguccaauggagauaagggcagcgggggaaucaaaggcggcuuuguucaucaacgcauggcuucuaagauugggagaugguacagccggaccauguccaaaaccaagagaaugggaaugggccuguaugugaaauacgacggggaccccuggaucgauucugacgcgcugacacucagcggagucaugguguccauggaggagccuggcugguacagcuucggguuugaaauuaaggauaagaaaugcgacgugccguguaucggcauugagaugguccacgauggaggcaagaaaaccuggcauucugccgcuacagccaucuauugccugaugggguccggacagcuucugugggacacgguuaccggcguggauauggcccucuga

SEQ ID NO: 211628 - RNA, 1401 nt, Artificial Sequence
  derived and/or modified sequence opt5 from neuraminidase__InfluenzaB__ABL76302
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccgggaggaccgcaauaagcugagacaucugaucuccgucaagcucggcaaaauucccacaguggagaacagcaucuuccacauggccgcuuggucuggguccgccugccaugauggacgggaauggaccuauauuggcguugacgggccggauagcaaugcucugcuuaagaucaaauacggagaggccuacacggacacauaucacucuuacgcgaacaauauucugcgcacccaggaauccgccuguaacugcaucggcgggaauuguuaucucaugauuacagauggaagcgcuuccggcaucucugagugcagauuucugaagauccgggagggccgcauuaucaaagaaauuuucccuaccgggagagugaagcacaccgaggaauguacaugcggauuugccagcaacaagacgaucgagugugcuugccgggacaauuccuacaccgccaaacgccccuucgucaaacuuaacguggaaacagauaccgccgagauuagacugaugugcacagagaccuaucucgacacgccucggcccgaugacggcagcaucacagggcccugugaaucuaauggagauaagggcuccgggggaaucaagggcggcuuuguucaucaacgcauggcuagcaaaauugggagaugguacucucggaccaugagcaagaccaaaagaaugggaaugggccuguaugugaaguacgacggggacccuuggacagauuccgacccgcuggcgcucucuggagucauggugagcauggaggaacccggcugguacuccuucggguuugagaucaaggauaaaaagugcgacgugccuuguauuggcaucgaaaugguccacgauggaggcaaagagaccuggcauagcgccgcuacagccauuuauugccugauggggucuggacagaugcuuugggacacgguuaccggcguggauauggcccuguga

SEQ ID NO: 211629 - RNA, 1401 nt, Artificial Sequence
  derived and/or modified sequence opt5 from neuraminidase__InfluenzaB__ABL76313
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucaacugcgccaaugcgucuaacguucaagcugugaauagaagcgccacaaagggagugaccuucccucugcccgaaccugaguggacauauccccggcuuuccuguccuggcagcaccuuucagaaagcccugcucauuucuccgcaccgcuucggggaaacgaagggaaacuccgcuccccugaucauuagagagccuuuuaucgccugcggccccaaagaauguaagcauuucgcucuuacccacuacgccgcgcagccugggggauauuacaauggcacacgggaggaucgcaacaagcugagacaucucaucagcgucaaacugggcaagauucccaccguggaaaauucuaucuuucacauggccgcuugguccgggagcgccugccaugacggacgggaauggacauauauuggcguugaugggccggacucuaacgcucugcucaaaaucaaguacggagaggccuacaccgauacguaucacuccuacgcgaauaacauucugcgcacacaggaaagcgccuguaauugcaucggcggggacuguuaucuuaugauuaccgauggauccgcuucuggcaucagcgagugcagauuccugaaaauccgggagggccgcauuaucaaggaaauuuuuccuacagggagaguggagcacaccgaagaguguaccugcggauucgccuccaacaagacaaucgaaugugcuugccgggacaauagcuacacggccaaacgccccuuugucaagcucaacguggagaccgauacagccgagauuagacugaugugcaccgaaacauaucuugacaccccucggcccgaugacggcucuaucacggggcccugugaguccaauggagauaaaggcagcgggggaaucaagggcggcuucguucaucaacgcauggcuucuaaaauugggagaugguacagccggacaauguccaagaccaaaagaaugggaaugggccuguaugugaaguacgacggggacccuuggaucgauucugacgcgcucacccugagcggagucaugguguccguggaggagccgggcugguacagcuuuggguucgaaauuaaggauaaaaagugcgacguccccuguaucggcauugagaugguucacgauggaggcaaaacaaccuggcauucugccgcuacagccaucuauugccugaugggguccggacagcuccugugggacacggugaccggcguggauauggcccuuuga

SEQ ID NO: 211630 - RNA, 1401 nt, Artificial Sequence
  derived and/or modified sequence opt5 from neuraminidase__InfluenzaB__ABL76335
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucaacugcgccaaugcgucuaacguucaagcugugaauagaagcgccaccaaaggagugacacugccucuucccgaaccugaguggaccuauccccggcuguccuguccuggcagcacguuccagaaggcccuccugauuucuccgcaccgcuuuggggaaaccaaaggaaacuccgcuccccuuaucauuagagagccuuucaucgccugcggccccaaggaauguaaacauuuugcucugacacacuacgccgcgcagccugggggauauuacaauggcacccgggaggaucgcaacaagcucagacaucugaucagcgucaagcugggcaaaauucccacaguggaaaauucuaucuuccacauggccgcuugguccgggagcgccugccaugacggacgggaauggaccuauauuggcguugaugggccggacucuaacgcucuccugaagaucaaauacggagaggccuacacggauacauaucacuccuacgcgaauaacauucuucgcacccaggaaagcgccuguaauugcaucggcggggacuguuaucugaugauuacagauggauccgcuucuggcaucagcgagugcagauuucucaagauccgggagggccgcauuaucaaagaaauuuucccuaccgggagaguggagcacaccgaagaguguacaugcggauuugccuccaacaagacgaucgaaugugcuugccgggacaauagcuacaccgccaagcgccccuucgucaaacugaacguggagacagauaccgccgagauuagacuuaugugcacagaaaccuaucuggacacgccucggcccgaugacggcucuaucacagggcccugugaguccaauggagauaagggcagcgggggaaucaaaggcggcuuuguucaucaacgcauggcuucuaagauugggagaugguacagccggaccauguccaaaaccaagagaaugggaaugggccucuaugugaaauacgacggggacccuuggaucgauucugacgcgcugacacugagcggagucaugguguccauggaggagccgggcugguacagcuucggguuugaaauuaaggauaagaaaugcgacgugcccuguaucggcauugagaugguccacgauggaggcaagaccacauggcauucugccgcuacggccaucuauugccucaugggguccggacagcugcuuugggacaccguuacaggcguggauauggcccuguga

SEQ ID NO: 211631 - RNA, 1401 nt, Artificial Sequence
  derived and/or modified sequence opt5 from neuraminidase__InfluenzaB__ABL76346
augcugcccagcaccauccagacacucacgcuguuccuuaccuccggcggggugcugcucucucuguacgucagcgccucccuuucuuaucugcucuacagcgacauucugcugaaguuuuccccuaaagagaucacaaccccgacaaugccccucaacugcgcuaaugccucuaacguucaagcggugaauagaagcgcuaccaagggagugacacugcuucugccugaacccgaguggaccuauccucggcucuccugucccggcagcacguuccagaaagcccugcuuauuucuccucaccgcuuuggggaaaccaagggaaacuccgccccgcugaucauuagagagcccuucaucgcuugcggcccuaaagaauguaagcauuuugcccucacacacuacgcugcccagcccgggggauauuacaauggcacccgggaggaucgcaacaagcugagacaucugaucagcgucaaacucggcaagauuccuacaguggaaaauucuaucuuccacauggcggccugguccgggagcgcuugccaugacggacgggaauggaccuauauuggcguugaugggcccgacucuaacgcccugcuuaaaaucaaguacggagaggcuuacacggauacauaucacuccuacgccaauaacauucugcgcacccaggaaagcgcguguaauugcaucggcggggacuguuaucucaugauuacagauggauccgccucuggcaucagcgagugcagauuucugaaaauccgggagggccgcauuaucaaggaaauuuucccgaccgggagaguggagcacaccgaagaguguacaugcggauuugcuuccaacaagacgaucgaaugugccugccgggacaauagcuacaccgcuaaacgcccuuucgucaaacuuaacguggagacagauaccgccgagauuagacugaugugcacagaaaccuaucucgacacgccccggccugaugacggcucuaucacagggcccugugaguccaauggagauaagggcagcgggggaaucaagggcggcuuuguucaucaacgcauggccucuaaaauugggagaugguacagccggaccauguccaagaccaaaagaaugggaaugggccuguaugugaaguacgacggggaccccuggaucgauucugacgcucugacacucagcggagucaugguguccauggaggagccuggcugguacagcuucggguuugaaauuaaggauaaaaagugcgacgugccguguaucggcauugagaugguccacgauggaggcaaaaccacauggcauucugcggccacggcuaucuauugccugaugggguccggacagcuucugugggacaccguuacaggcguggauauggcccucuga

SEQ ID NO: 211632 - RNA, 1401 nt, Artificial Sequence; identical to SEQ ID NO: 211631
  derived and/or modified sequence opt5 from neuraminidase__InfluenzaB__ABL76357

SEQ ID NO: 211633 - RNA, 1401 nt, Artificial Sequence
  derived and/or modified sequence opt5 from neuraminidase__InfluenzaB__ABL76368
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcgugaagcacaccgaggaauguacaugcggauuugccuccaacaaaacgaucgagugugcuugcagagacaauagcuacaccgccaagcggccuuucgucaaacuuaacguggaaacagauaccgccgagauucgccugaugugcacagagaccuaucucgacacgcccagaccugaugacggcucuaucacagggcccugugaauccaauggagauaagggcagcgggggaaucaaaggcggcuuuguucaucaacggauggcuucuaagauugggcgcugguacagcagaaccauguccaaaaccaagcggaugggaaugggccuguaugugaaguacgacggggaccccuggacagauucuggagcgcuggcccucagcggcgucaugguguccauggaggaaccugggugguacagcuucggcuuugagaucaaagacaagaaaugcgaugugccguguauuggaaucgaaaugguccacgacggcgggaaggagaccuggcauucugcugccacagccauuuauugccugaugggauccggccagcuucugugggauacgguuaccgggguggacauggcucucuga

SEQ ID NO: 211634 - RNA, 1404 nt, Artificial Sequence
  derived and/or modified sequence opt5 from neuraminidase__InfluenzaB__ABL76379
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacauuccugcuucugccugaacccgaguggaccuauccucggcucuccugucccggcagcacguuucagaaggcccugcuuauuucuccucaccgcuucggggaaaccaaaggaaauuccgcuccgcugaucauuagagagcccuuuaucgccugcggcccuaaggaauguaaacauuucgcucucacacacuacgccgcgcagcccgggggauauuacaacggcacccggggcgaccgcaauaagcugagacaucugaucagcgucaagcucgggaaaauuccuacaguggagaacucuaucuuucacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuccugaaaaucagagaggggcggauuaucaaggagauuuuuccgaccggacgcgugaagcacaccgaagaguguacaugcggcuucgccuccaacaaaacgaucgaaugugcuugcagagacaauagcuacaccgccaagcggccuuuugucaaacuuaacguggagacagauaccgccgaaauucgccugaugugcacagagaccuaucucgacacgcccagaccugaugacgggucuaucacaggacccugugaguccaauggcgauaaggggagcggaggcaucaaaggcggguucguucaucaacggauggcuucuaagauuggacgcugguacagcagaaccauguccaaaaccaagcggaugggcauggggcuguaugugaaguacgacggagaccccuggacagauucugacgcgcuggcccucagcggcgucaugguguccauggaggaaccugggugguacagcuuuggcuucgaaaucaaagauaagaaaugcgacgugccguguauuggaaucgagaugguccacgauggcgggaaggaaaccuggcauucugcugccacagccauuuauugccugaugggauccggccagcuucugugggacacgguuaccgggguggauauggcucucuga

SEQ ID NO: 211635 - RNA, 1401 nt, Artificial Sequence
  derived and/or modified sequence opt5 from neuraminidase__InfluenzaB__ABL76390
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcuccaccaaaggagugacauuccugcuuccugaacccgaguggaccuauccucggcugagcugucccggcucuacguuucagaaggcccuccugauuuccccucaccgcuucggggaaaccaaaggaaauagcgccccgcuuaucauuagagagcccuuuaucgcuugcggcccuaaggaauguaaacauuucgcccugacacacuacgcugcccagcccgggggauauuacaacggcacccgggaggaccgcaauaagcucagacaucugaucucugucaagcugggcaaaauuccuacaguggagaacuccaucuuucacauggcggccuggagcgggucugcuugccaugauggaaaggaauggaccuauauuggcguugacgggcccgauuccaaugcccuccugaaaaucaaguacggagaggcuuacacggacacauaucacagcuacgccaacaauauucuucggacccaggaauccgcguguaacugcaucggcgggaauuguuaucugaugauuacagauggaucugccagcggcaucuccgagugccgcuuccucaaaaucagagagggccggauuaucaaggaaauuuuuccgaccgggcgcgugaagcacaccgaggaauguacaugcggauucgcuagcaacaaaacgaucgagugugccugcagagacaauucuuacaccgcuaagcggccuuuugucaaacugaacguggaaacagauaccgccgagauucgccuuaugugcacagagaccuaucuggacacgcccagaccugaugacggcuccaucacagggagcugugaaucugauggagacaagggcagcgggggaaucaaaggcggcuucguucaucaacggauggccuccaagauugggcgcugguacucuagaaccaugagcaaaaccaagcggaugggaaugggccucuaugugagauacgacggggaucccuggacagacuccagcgcucuggcgcugucuggagucaugguguccauggaggaacccggcugguacagcuuuggguucgagaucaaggauaaaaagugcgacgugccuuguauuggcaucgaaaugguccacgauggaggcaaagagaccuggcauucugccgcuacagccauuuauugccucaugggguccggacagcugcuuugggacacgguuaccggcguggauauggcccuguga

SEQ ID NO: 211636 - RNA, 1401 nt, Artificial Sequence
  derived and/or modified sequence opt5 from neuraminidase__InfluenzaB__ABL76412
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuuauuccugaacccgaguggaccuauccucggcuguccugucccggcagcacguuccagaaggcccuccugaucucuccucaccgcuuuggggaaaccaaaggaaauuccgcuccgcuuauuaucagagagcccuucaucgccugcggcccuaaggaauguaaacauuuugcucugacacacuacaccgcccagcccgggggauauuacaacggcacacggggcgaccgcaauaagcucagacaucugauuagcgucaagcuggggaaaaucccuaccguggagaacucuauuuuccacauggcggccugguccggaagcgcuugccaugauggcaaggaguggacguauaucgggguugacggacccgauucuaaugcccuccugaaaauuaaguacggcgaggcuuacacagacaccuaucacuccuacgccaacaauauccuucggacacaggagagcgcguguaacugcauugggggaaauuguuaucugaugaucaccgauggcuccgccucuggcaucagcgaaugccgcuuucucaaaauuagagaggggcggaucauuaaggagaucuucccgaccggacgcgugaagcacacagaagaguguacgugcggcuuugcuuccaacaaaaccauugaaugugccugcagagacaauagcuacacagcuaagcggccuuucgucaaacugaacguggagaccgauacagccgaaauccgccuuaugugcaccgagacguaucuggacacacccagaccugaugacgggucuaucaccggacccugugaguccaauggcgauaaggggagcggaggcauuaaaggcggguuuguucaucaacggauggccucuaagaucggacgcugguacagcagaaccauguccaaaacaaagcggaugggcauggggcucuaugugaaguacgacggagaccccuggaccgauucugacgcucuggcgcugagcggcgucaugguguccauggaagaaccugggugguacagcuucggcuuugaaauuaaagauaagaaaugcgacgugccguguaucggaauugagaugguccacgauggcgggaaggaaacauggcauucugccgcuacggccaucuauugccucaugggauccggccagcugcuuugggacaccguuacagggguggauauggcccuguga

SEQ ID NO: 211637 - RNA, 1401 nt, Artificial Sequence
  derived and/or modified sequence opt5 from neuraminidase__InfluenzaB__ABL76423
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaaggaauguaaacacuuugcucucacacauuacgccgcgcagcccgggggauauuacaacggcaccagaggcgaccggaauaagcugcgccaccugaucagcgucaagcucgggaaaauuccuacaguggagaacucuaucuuccauauggccgcuugguccggaagcgccugccacgauggcaaggaguggaccuauauugggguugacggacccgauucuaaugcucugcuuaaaaucaaguacggcgaagccuacacggacacauaucacuccuacgcgaacaauauucugagaacccaggagagcgccuguaacugcaucgggggaaauuguuaucucaugauuacagauggcuccgcuucuggcaucagcgaaugccgguuucugaaaauccgcgaggggagaauuaucaaggagauuuucccgaccggacgggugaagcauaccgaagaguguacaugcggcuuugccuccaacaaaacgaucgaaugugcuugccgcgacaauagcuacaccgccaagagaccuuucgucaaacuuaacguggagacagauaccgccgaaauucggcugaugugcacagagaccuaucucgacacgccccgcccugaugacgggucuaucacaggacccugugaguccaauggcgauaaggggagcggaggcaucaaaggcggguuuguucaccaaagaauggcuucuaagauuggacggugguacagccgcaccauguccaaaaccaagagaaugggcauggggcuguaugugaaguacgacggagaccccuggacagauucugacgcgcuggccuucagcggcgucaugguguccauggaggaaccugggugguacagcuuuggcuucgaaaucaaagauaagaaaugcgacgugccguguauuggaaucgagaugguccaugauggcgggaaggaaaccuggcacucugcugccacagccauuuauugccucaugggauccggccagcugcuuugggacacgguuaccgggguggauauggcucuguga

SEQ ID NO: 211638 - RNA, 1401 nt, Artificial Sequence
  derived and/or modified sequence opt5 from neuraminidase__InfluenzaB__ABL76434
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccuggcucucucuggcgucauggugagcauggaggaaccugggugguacuccuucggcuuugaaaucagagauaaaaagugcgacgugccguguauuggaaucgagaugguccacgauggcgggaaagaaacauggcauagcgccgccaccgcuauuuauugccugaugggaucuggccagcuucugugggacacaguuacggggguggauauggcccucuga

SEQ ID NO: 211639 - RNA, 1401 nt, Artificial Sequence
  derived and/or modified sequence opt5 from neuraminidase__InfluenzaB__ABL76456
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugaagcugcuucugccugaacccgaguggacauauccucggcucuccugucccggcagcaccuuccagaaagcccugcuuauuucuccucaccgcuuuggggaaacgaagggaaauuccgcuccgcugaucauuagagagcccuucaucgccugcggcccuaaagaauguaagcauuuugcucucacccacuacgccgcgcagcccgggggauauuacaacggcacacggggcgaccgcaauaagcugagacaucugaucagcgucaaacucgggaagauuccuaccguggagaacucuaucuuccacauggccgcuugguccggaagcgccugccaugauggcaaagaguggacauauauugggguugacggacccgauaauaacgcucugcuuaagaucaaauacggcgaagccuacaccgacacguaucacucuuacgcgaauaacauucugcggacacaggaguccgccuguaauugcaucgggggaaacuguuaucucaugauuaccgauggcagcgcuuccggcgugucugaaugccgcuuucugaagaucagagaggggcggaucauuaaggagaucuucccgacaggacgcgucaaacacaccgaagaguguaccugcggcuuugccagcaauaagacaauugaaugugcuugcagagacaacuccuacacggccaaacggccuuucgugaaacuuaauguugagaccgauacagccgaaauccgccugaugugcaccgagacauaucucgacacccccagaccugaugacgggagcauuacgggacccugugagucuaacggcgauaagggguccggaggcaucaagggcggguuugugcaucaacggauggcuagcaaaaucggacgcugguacucuagaacaaugagcaagaccaagcggaugggcauggggcuguaugucaaauacgacggagaccccugggcggauuccgacgcccuggcucucucuggcgugauggugagcauggaggaaccugggugguacuccuucggcuuugaaauuaaggauaaaaagugcgacgucccguguaucggaauugagaugguucacgauggcgggaaagaaaccuggcauagcgccgccacagcuaucuauugccugaugggaucuggccagcuucugugggacaccgugacagggguggauauggcccucuga

SEQ ID NO: 211640 - RNA, 1401 nt, Artificial Sequence
  derived and/or modified sequence opt5 from neuraminidase__InfluenzaB__ABL76467
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccuggcucucucuggcgucauggugagcauggaggaaccugggugguacuccuucggcuuugaaaucaaagauaagaaaugcgacgugccguguauuggaaucgagaugguccacgauggcgggaaggaaacauggcauagcgccgccaccgcuauuuauugccugaugggaucuggccagcuucugugggacacaguuacggggguggauauggcccucuga

SEQ ID NO: 211641 - RNA, 1401 nt, Artificial Sequence
  derived and/or modified sequence opt5 from neuraminidase__InfluenzaB__ABL76478
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugaagcugcuucugccugaacccgaguggacauauccucggcucuccugucccggcagcaccuuccagaaagcccugcuuauuucuccucaccgcuuuggggaaacgaagggaaauuccgcuccgcugaucauuagagagcccuucaucgccugcggcccuaaagaauguaagcauuuugcucucacccacuacgccgcgcagcccgggggauauuacaacggcacacggggcgaccgcaauaagcugagacaucugaucagcgucaaacucgggaagauuccuaccguggagaacucuaucuuccacauggccgcuugguccggaagcgccugccaugauggcaaagaguggacauauauugggguugacggacccgauaauaacgcucugcuuaagaucaaauacggcgaagccuacaccgacacguaucacucuuacgcgaauaacauucugcggacacaggaguccgccuguaauugcaucgggggaaacuguuaucucaugauuaccgauggcagcgcuuccggcgugucugaaugccgcuuucugaagaucagagaggggcggaucauuaaggagaucuucccgacaggacgcgucaaacacaccgaagaguguaccugcggcuuugccagcaauaagacaauugaaugugcuugcagagacaacuccuacacggccaaacggccuuucgugaaacuuaauguugagaccgauacagccgaaauccgccugaugugcaccaagacauaucucgacacccccagaccugaugacgggagcauuacgggacccugugagucuaacggcgauaagggguccggaggcaucaaaggcggguuugugcaucaacggauggcuagcaagaucggacgcugguacucuagaacaaugagcaagaccaaacggaugggcauggggcuguaugucaaguacgacggagaccccugggcggauuccgacgcccuggcucucucuggcgugauggugagcauggaggaaccugggugguacuccuucggcuuugagauuaaagauaagaaaugcgacgucccguguaucggaauugaaaugguucacgauggcgggaaggagaccuggcauagcgccgccacagcuaucuauugccugaugggaucuggccagcuucugugggacaccgugacagggguggauauggcccucuga

SEQ ID NO: 211642 - RNA, 1401 nt, Artificial Sequence
  derived and/or modified sequence opt5 from neuraminidase__InfluenzaB__ABL76522
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagagaccuaucucgacacgcccagaccugaugacgggagcauuacaggacccugugagucuaacggcgauaagggguccggaggcaucaagggcggguuugugcaucaacggauggcuagcaaaaucggacgcugguacucuagaaccaugagcaagaccgaacggaugggcauggggcuguaugucaaauacgacggagaccccugggcggauuccgacgcccuggcucucucuggcgugauggugagcauggaggaaccugggugguacuccuucggcuuugagauuaaggauaagaaaugcgacgucccguguaucggaauugaaaugguucacgauggcgggaaggagacauggcauagcgccgccaccgcuaucuauugccugaugggaucuggccagcuucugugggacacagugacggggguggauauggcccucuga

SEQ ID NO: 211643 - RNA, 1401 nt, Artificial Sequence
  derived and/or modified sequence opt5 from neuraminidase__InfluenzaB__ABL76533
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcaaacggggcgaccgcaacaagcugagacaucugaucagcgucaagcucgggaaaauuccuaccguggaaaauucuaucuuccacauggccgcuugguccggaagcgccugccaugauggcaaggaguggacauauauugggguugacggacccgauaacaaugcucugcuuaaaaucaaguacggcgaggccuacaccgacacguaucacucuuacgcgaacaauauucugcggacacaggaguccgccuguaacugcaucgggggaaauuguuaucucaugauuaccgauggcagcgcuuccggcgugucugaaugccgcuuucugaaaaucagagaggggcggaucauuaaggagaucuucccgacaggacgcgucaagcacaccgaagaguguaccugcggcuuugccagcaacaaaacaauugaaugugcuugcagagacaauuccuacacggccaagcggccuuucgugaaacuuaacguugagaccgauacagccgaaauccgccugaugugcaccgagacauaucucgacacccccagaccugaugacgggagcauuacgggacccugugagucuaacggcgauaagggguccggaggcaucaaaggcggguuugugcaucaacggauggcuagcaagaucggacgcugguacucuagaacaaugagcaaaaccgaacggaugggcauggggcuguaugucaaguacgacggagaccccugggcggauuccgacgcccuggcucucucuggcgugauggugagcauggaggaaccugggugguacuccuucggcuuugagauuaaggauaaaaagugcgacgucccguguaucggaauugaaaugguucacgauggcgggaaagagaccuggcauagcgccgccacagcuaucuauugccugaugggaucuggccagcuucugugggacaccgugacagggguggauauggcccucuga

SEQ ID NO: 211644 - RNA, 1401 nt, Artificial Sequence
  derived and/or modified sequence opt5 from neuraminidase__InfluenzaB__ABL76544
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgagcgcaacaaacugagacaucugaucagcgucaagcucgggaagauuccuacaguggaaaauucuaucuuccacauggccgcuugguccggaagcgccugccaugacggcaaagaauggaccuauauugggguugauggacccgacaacaaugcucugcuuaagaucaaauacggcgaggccuacacggauacauaucacucuuacgcgaacaauauucugcggacccaggaauccgccuguaacugcaucgggggaaauuguuaucucaugauuacagacggcagcgcuuccggcgugucugagugccgcuuucugaagaucagagaggggcggaucauuaaagaaaucuucccgaccggacgcgucaagcacaccgaggaauguacaugcggcuuugccagcaacaagacgauugagugugcuugcagagauaauuccuacaccgccaaacggccuuucgugaaacuuaacguugaaacagacaccgccgagauccgccugaugugcacagagaccuaucucgauacgcccagaccugacgaugggagcauuacaggacccugugaaucuaacggcgacaagggguccggaggcaucaagggcggguuugugcaucaacggauggcuagcaaaaucggacgcugguacucuagaaccaugagcaagaccgagcggaugggcauggggcuguaugucaaauacgauggagaccccugggcggacuccgaugcccuggcucucucuggcgugauggugagcauggaggagccugggugguacuccuucggcuuugaaauuaaggacaagaaaugcgaugucccguguaucggaauugagaugguucacgacggcgggaaggagacauggcauagcgccgccaccgcuaucuauugccugaugggaucuggccagcuucugugggauacagugacggggguggacauggcccucuga

SEQ ID NO: 211645 - RNA, 1401 nt, Artificial Sequence; identical to SEQ ID NO: 211643
  derived and/or modified sequence opt5 from neuraminidase__InfluenzaB__ABL76566

SEQ ID NO: 211646 - RNA, 1401 nt, Artificial Sequence
  derived and/or modified sequence opt5 from neuraminidase__InfluenzaB__ABL76588
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauuaugccaacgcgucuaauguucaagcugugaacagaagcgccaccaaaggagugacacugcuucugccugaacccgaguggaccuacccucggcucuccugccccggcagcacguuccagaaggcccugcuuauuucuccucaccgcuuuggggaaaccaaaggaaauuccgcuccgcugaucauuagagagcccuucaucgccuguggcccuaacgaaugcaagcauuuugcucucacacacuaugccgcgcagcccgggggauacuauaauggcacccggggcgaccgcaacaaacugagacaucugaucagcgucaagcucgggaagauuccuacaguggaaaauucuaucuuccacauggccgcuugguccggaagcgccugucaugauggcaaagaguggaccuacauugggguugacggacccgauaacaaugcucugcuuaagaucaaauacggcgaggccuauacggacacauaccacucuuaugcgaacaauauucugcggacccaggaguccgccugcaacuguaucgggggaaauugcuaccucaugauuacagauggcagcgcuuccggcgugucugaaugucgcuuucugaagaucagagaggggcggaucauuaaagagaucuucccgaccggacgcgucaagcacaccgaagagugcacauguggcuuugccagcaacaagacgauugaaugcgcuuguagagacaauuccuauaccgccaaacggccuuucgugaaacuuaacguugagacagauaccgccgaaauccgccugaugugcacagagaccuaccucgacacgcccagaccugaugacgggagcauuacaggacccugcgagucuaacggcgauaagggguccggaggcaucaagggcggguuugugcaucaacggauggcuagcaaaaucggacgcugguauucuagaaccaugagcaagaccgaacggaugggcauggggcuguacgucaaauacgacggagaccccugggcggauuccgacgcccuggcucucucuggcgugauggugagcauggaggaaccugggugguauuccuucggcuuugagauuaaggauaagaaaugugacgucccgugcaucggaauugaaaugguucacgauggcgggaaggagacauggcauagcgccgccaccgcuaucuacugucugaugggaucuggccagcuucugugggacacagugacggggguggauauggcccucuga

SEQ ID NO: 211647 - RNA, 1401 nt, Artificial Sequence; identical to SEQ ID NO: 211642
  derived and/or modified sequence opt5 from neuraminidase__InfluenzaB__ABL76599

SEQ ID NO: 211648 - RNA, 1401 nt, Artificial Sequence; identical to SEQ ID NO: 211642
  derived and/or modified sequence opt5 from neuraminidase__InfluenzaB__ABL76610

SEQ ID NO: 211649 - RNA, 1401 nt, Artificial Sequence
  derived and/or modified sequence opt5 from neuraminidase__InfluenzaB__ABL76621
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagagaccuaucucgacacgcccagaccugaugacgggagcauuacaggacccugugagucuaacggcgaaaagggguccggaggcaucaaaggcggguuugugcaucaacggauggcuagcaagaucggacgcugguacucuagaaccaugagcaaaaccaagcggaugggcauggggcuguaugucaaguacgauggagaccccugggcggacuccgaugcccuggcucucucuggcgugauggugagcauggaggaaccugggugguacuccuucggcuuugagauuaaagacaagaaaugcgauaucccguguauuggaaucgaaaugguccacgacggcgggaaggagacauggcauagcgccgccaccgcuauuuauugccugaugggaucuggccagcuucugugggauacaguuacggggguggacauggcccucuga

SEQ ID NO: 211650 - RNA, 1401 nt, Artificial Sequence
  derived and/or modified sequence opt5 from neuraminidase__InfluenzaB__ABL76632
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaaaugagacaucugauuagcgucaagcugggcaagauccccacaguggagaacucuauuuuccacauggccgcuugguccgggagcgccugccaugauggaaaagaauggaccuauaucggcguugacgggccugauucuaaugcucuccugaagauuaaauacggagaggccuacacggacacauaucacuccuacgcgaagaacauccuucggacccaagaaagcgccuguaauugcauuggcggggauuguuaucugaugaucacagacggacccgcuuccggcaucucugagugccgcuuucucaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacugaacguggaaacagacaccgccgagauccgccuuaugugcacagagaccuaucuggauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccucuaugugaaguacgacggggaucccuggacagacuccgaggcgcuggcccugucuggagucauggugagcauggaggaaccuggcugguacuccuucggguuugaaauuaaagauaagaaaugcgacgugccguguaucggcauugagaugguccacgauggaggcaagaccacauggcauagcgcugccacggccguuuauugccucauggggucuggacagcugcuuugggacaccgugacaggcguggauauggcucuguga

SEQ ID NO: 211651 - RNA, 1401 nt, Artificial Sequence
  derived and/or modified sequence opt5 from neuraminidase__InfluenzaB__ABL76643
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccuguaugugaaguacgacggggaucccuggacagacuccgaggcgcuggcccucucuggagucauggugagcauggaggaaccuggcugguacuccuucggguuugaaauuaaagauaagaaaugcgacgugccguguaucggcauugagaugguccacgauggaggcaagaccacauggcauagcgcugccacggccaucuauugccugauggggucuggacagcuucugugggacaccguuacaggcguggauauggcucucuga

SEQ ID NO: 211652 - RNA, 1401 nt, Artificial Sequence
  derived and/or modified sequence opt5 from neuraminidase__InfluenzaB__ABL76654
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcacaaccaaaggagugacacugcuucugcccgaaccugaguggaccuauccccggcucuccuguccuggcagcacguuccagaaggcccugcuuaucucuccccaccgcuuuggggaaaccaaaggaaauuccgccccucugauuaucagagagccguucaucgcuugcggccccacagaauguaagcauuuugcccucacccacuacgcugcccagccugggggauauuacaacggcacacgggaggaccgcaauaaacugagacaucugauuagcgucaagcucggcaagauccccaccguggagaacucuauuuuccacauggcggccugguccgggagcgcuugccaugauggaaaagaauggacguauaucggcguugacgggccugauucuaaugcccugcuuaagauuaaauacggagaggcuuacacagacaccuaucacuccuacgccaagaacauccugcggacacaagaaagcgcguguaauugcauuggcggggauuguuaucucaugaucaccgacggacccgccuccggcaucucugagugccgcuuucugaaaauuagagagggccggaucauuaaggaaaucuucccgaccgggcgcgugaagcacacagaggaauguacgugcggauuugcuagcaacaaaaccauugagugugccugcagagauaauuccuacacagcuaagcggccuuucgucaaacuuaacguggaaaccgacacagccgagauccgccugaugugcaccgagacguaucucgauacacccagaccuaaugacggcagcaucaccgggcccugugaaucugauggagacaagggcuccgggggaauuaaaggcggcuuuguucaucagcggauggccagcaagaucgggcgcugguacucuagaaccaugagcaaaacaaagcggaugggaaugggccuguaugugaaguacgacggggaucccuggaccgacuccgaggcucuggcgcucucuggagucauggugagcauggaggaaccuggcugguacuccuucggguuugaaauuaaagauaagaaaugcgacgugccguguaucggcauugagaugguccacgauggaggcaagacaacguggcauagcgccgcuaccgccaucuauugccugauggggucuggacagcuucugugggacacaguuaccggcguggauauggcccucuga

SEQ ID NO: 211653 - RNA, 1401 nt, Artificial Sequence
  derived and/or modified sequence opt5 from neuraminidase__InfluenzaB__ABL76665
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaauuugauggagacaagggcucugggggaauuaaaggcggcuucguucaucagcggauggcuuccaagaucgggcgcugguacagcagaaccaugucuaaaaccaagcggaugggaaugggccuguaugugaaguacgacggggaucccuggacagacagcgaggcgcuggcccucuccggagucauggugucuauggaggaaccuggcugguacagcuuuggguucgaaauuaaagauaagaaaugcgacgugccguguaucggcauugagaugguccacgauggaggcaagaccacauggcauuccgcugccacggccaucuauugccugauggggagcggacagcuucugugggacaccguuacaggcguggauauggcucucuga

SEQ ID NO: 211654 - RNA, 1401 nt, Artificial Sequence
  derived and/or modified sequence opt5 from neuraminidase__InfluenzaB__ABL76676
augcugcccagcaccauccagacacucacgcuguuccuuaccuccggcggggugcugcucucucuguacgucagcgccucccuuucuuaucugcucuacagcgacauucugcugaaguuuucccaaacaggaaucaccgcuccuauuaugccgcucgauugcgccaacgcgucuaauguucaggcugugaacagaagcgccacaaaaggcgugacccugcuucugcccgagccugaauggacauauccccggcucuccuguccugggagcaccuuccagaaggcccugcuuaucucuccccaccgcuuuggagagacgaaaggcaauuccgcuccucugauuaucagagaaccguucaucgccugcgggcccaaggaguguaaacauuuugcucucacccacuacgccgcgcagccuggaggcuauuacaacggcacacgggaagaccgcaauaagcugagacaucugauuagcgucaagcucgggaaaauccccaccguggagaacucuauuuuccacauggccgcuugguccggaagcgccugccaugauggccgggaguggacauauaucgggguugacggaccugauucuaaugcucugcuuaagauuaaauacggcgaagccuacaccgacacguaucacuccuacgcgaagaacauccugcgcacacaagagagcgccuguaauugcauugggggagauuguuaucucaugaucaccgacggccccgcuuccggcaucucugaaugcagauuucugaaaauucgggaggggcgcaucauuaaggagaucuucccgacaggaagagugaagcacaccgaagaguguaccugcggcuuugccagcaacaaaacaauugaaugugcuugccgggauaauuccuacacggccaagcgcccuuucgucaaacuuaacguggagaccgacacagccgaaaucagacugaugugcaccgagacauaucucgauacgccccggccuaaugacgggagcaucaccggacccugugagucuaacggcgauaagggguccggaggcauuaaaggcggguuuguucaucagcgcauggcuagcaagaucggaagaugguacucucggacaaugagcaaaaccaagagaaugggcauggggcuguaugugaaguacgacggagaccccuggaccgauuccgaagcgcuggcccucucuggcgucauggugagcauggaggaaccugggugguacuccuucggcuuugagauuaaagacaagaaaugcgaugugccguguaucggaauugaaaugguccacgacggcgggaagacaaccuggcauagcgcugccacagccaucuauugccugaugggaucuggccagcuucugugggauacgguuaccgggguggacauggcucucuga

SEQ ID NO: 211655 - RNA, 1401 nt, Artificial Sequence
  derived and/or modified sequence opt5 from neuraminidase__InfluenzaB__ABL76687
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaauuugauggagacaagggcucugggggaauuaaaggcggcuucguucaucagcggauggcuuccaagaucgggcgcugguacagcagaaccaugucuaaaaccaagcggaugggaaugggccuguaugugaaguacgacggggaucccuggacagacagcgaggcgcuggcccucuccggagucauggugccuauggaggaaccgggcugguacucuuuuggguucgaaauuaaagauaagaaaugcgacgugcccuguaucggcauugagaugguccacgauggaggcaagaccacauggcauagcgcugccacggccaucuauugccugaugggguccggacagcuucugugggacaccguuacaggcguggauauggcucucuga

SEQ ID NO: 211656 - RNA, 1401 nt, Artificial Sequence
  derived and/or modified sequence opt5 from neuraminidase__InfluenzaB__ABL76698
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggaaugacacugcuucugccugaacccgaguggaccuauccucggcucuccugucccggcagcacguuccagaaggcccugcuuauuucuccucaccgcuuuggggaaaccagaggaaauuccgcuccgcugacaauccgggagcccuucauugccugcggcccuaaagaauguaagcauuuugcucucacccacuacgccgcgcagcccgggggauauuacaacggcacacgcgaggacagaaauaaacugcggcaucugaucagcgugaagcucggcaagaucccuaccgucgagaacucuauuuuccacauggccgcuugguccgggagcgccugccaugauggacgcgaauggacguauaucggcguggacgggcccgauucuaaugcucugauuaaaaucaaguacggagaggccuacacagacaccuaucacuccuacgcgaacaauauucuuagaacacaggaaagcgccuguaacugcaucggcggggauuguuaucugaugauuaccgacggauccgcuucuggcaucagcaaaugccgguuucucaagauccgcgagggcagaauuaucaaagagauuuucccgaccgggcggguugaacacacagaggaauguacgugcggauuugccuccaauaagaccaucgagugugcuugccgcgauaacagcuacacagccaagagaccuuucgugaaacugaaugucgaaaccgacacagccgagauucggcuuaugugcaccgagacguaucuggauacaccccgcccugacgauggcucuaucaccgggcccugugaauccaacggagacaagggcagagggggaaucaaaggcggcuuugugcaucaacggauggcuagcaagauugggagaugguacucucgcaccaugagcaaaacagagcggaugggaauggaacucuauguuaaguacgacggcgaucccuggaccgacuccgaggcgcuggccccuucuggggugauggucagcauggaggaaccgggaugguacuccuucggcuuugagaucaaagauaagaagugcgacgugcccuguauugggaucgaaauggugcacgauggcggcaaaaagacauggcauagcgcugccacggccauuuauugccugaugggaucugggcagcuccugugggacaccgucacaggaguugauauggcucuuuga

SEQ ID NO: 211657 - RNA, 1401 nt, Artificial Sequence
  derived and/or modified sequence opt5 from neuraminidase__InfluenzaB__ABL76720
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggcuagcaagaucggacgcugguacucuagaaccaugagcaaaaccgagcggaugggcauggggcuguaugucaaguacgacggagaucccugggcggacuccgaugcccuggcuuucucuggcgugauggugagcaugaaggaaccugggugguacuccuuuggcuucgagauuaaagacaagaaaugcgaugucccguguaucggaauugaaaugguucacgacggcgggaaggagacauggagaagcgccgccaccgcuaucuauugccucaugggaucuggccagcugcuuugggauacagugacggggguggacauggcccuguga

SEQ ID NO: 211658 - RNA, 1401 nt, Artificial Sequence
  derived and/or modified sequence opt5 from neuraminidase__InfluenzaB__ABL76731
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcuaucacacauuacgccgcgcagcccgggggauauuacaauggcacccggggcgaccgcaacaaacucagacaccugauuagcgucaagcuggggaagaucccuacaguggaaaauucuauuuuccauauggccgcuugguccggaagcgccugccacgauggcaaagaguggaccuauaucgggguugacggacccgauaacaaugcucuccugaagauuaaauacggcgaggccuacacggacacauaucacucuuacgcgaacaauauccuucggacccaggaguccgccuguaacugcauugggggaaauuguuaucugaugaucacagauggcagcgcuuccggcgugucugaaugccgcuuucucaagaucagagaggggcggauuaucaaagagauuuucccgaccggacgcgucaagcauaccgaagaguguacaugcggcuuugccagcaacaagacgaucgaaugugcuugcagagacaauuccuacaccgccaaacggccuuucgugaagcugaacguugagacagauaccgccgaaauucgccuuaugugcacagacaccuaucuggauacgcccagaccugacgaugggagcaucacaggacccugugagucuaacggcgacaaaggguccggaggcaucaagggcggguuugugcaccagcggauggcuagcaaaauuggacgcugguacucuagaaccaugagcaagaccgagcggaugggcauggggcucuaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucaugacggcgggaaagagacauggcacagcgccgccaccgcuauuuauugccugaugggaucuggccaacuccugugggauacagugacggggguggacauggcccuuuga

SEQ ID NO: 211659 - RNA, 1401 nt, Artificial Sequence
  derived and/or modified sequence opt5 from neuraminidase__InfluenzaB__ABL76742
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggcuagcaagaucggacgcugguacucuagaaccaugagcaaaaccgagcggaugggcauggggcuguaugucaaguacgacggagaucccugggcggacuccgaugcccuggcuuucucuggcgugauggugagcaugaaggaaccugggugguacuccuuuggcuucgagauuaaagacaagaaaugcgaugucccguguaucggaauugaaaugguucacgacggcgggaaggagacauggcauagcgccgccaccgcuaucuauugccucaugggaucuggccagcugcuuugggauacagugacggggguggacauggcccuguga

SEQ ID NO: 211660 - RNA, 1401 nt, Artificial Sequence
  derived and/or modified sequence opt5 from neuraminidase__InfluenzaB__ABL76753
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaccggaaauuccgcuccucugauuaucagagagccguucaucgccugcggccccaaagaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggacgggaauggaccuauaucggcguugacgggccugauaauaacgcucugcuuaaaauuaaguacggagaggccuacacggacacauaucacucuuacgcgaaaaauauccugcgcacccaagaauccgccuguaacugcauuggcggggauuguuaucucaugaucacagacggacccgcuagcggcaucuccgagugcagauuucugaagauucgggagggccgcaucauuaaagaaaucuucccgaccgggagagugaagcacaccgaggaauguacaugcggauuugccucuaauaagacgauugagugugcuugccgggauaacagcuacaccgccaaacgcccuuucgucaaacuuaauguggaaacagacaccgccgagaucagacugaugugcacagagaccuaucucgauacgccccggccuaacgacggcuccaucacagggcccugugaaagcaauggagauaagggcucugggggaauuaagggcggcuuuguucaucagcgcauggcuuccaaaaucgggagaugguacagccggaccaugucuaagaccaaaagaaugggaaugggccuguaugugaaguacgacggggaccccuggacagauagcgaggcgcuggcccucuccggagucauggugucuauggaggaaccuggcugguacagcuucggguuugaaauuaaggacaaaaagugcgaugugccguguaucggcauugagaugguccacgacggaggcaaaaccacauggcauuccgcugccacggccaucuauugccugauggggagcggacagcuucugugggauaccguuacaggcguggacauggcucucuga

SEQ ID NO: 211661 - RNA, 1401 nt, Artificial Sequence; identical to SEQ ID NO: 211630
  derived and/or modified sequence opt5 from neuraminidase__InfluenzaB__ABL76764

SEQ ID NO: 211662 - RNA, 1401 nt, Artificial Sequence; identical to SEQ ID NO: 211630
  derived and/or modified sequence opt5 from neuraminidase__InfluenzaB__ABL76775

SEQ ID NO: 211663 - RNA, 1401 nt, Artificial Sequence
  derived and/or modified sequence opt5 from neuraminidase__InfluenzaB__ABL76797
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcguggagcacaccgaagaguguacaugcggauuugccuccaacaagacgaucgaaugugcuugcagagacaauagcuacaccgccaaacggccuuucgucaaacuuaacguggagacagauaccgccgagauucgccugaugugcacagaaaccuaucucgacacgcccagaccugaugacggcucuaucacagggcccugugaguccaauggagauaagggcagcgggggaaucaagggcggcuuuguucaucaacggauggcuucuaaaauugggcgcugguacagcagaaccauguccaagaccaaacggaugggaaugggccuguaugugaaguacgacggggaccccuggacagauucugacgcgcuggcccucagcggagucaugguguccauggaggaaccuggcugguacagcuucggguuugaaaucaaggauaaaaagugcgacgugccguguauuggcaucgagaugguccacgauggaggcaaagagaccuggcauucugcugccacagccauuuauugccugaugggguccggacagcuucugugggacacgguuaccggcgugaacauggcucucuga

SEQ ID NO: 211664 - RNA, 1401 nt, Artificial Sequence
  derived and/or modified sequence opt5 from neuraminidase__InfluenzaB__ABL76819
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcgugaagcacaccgaggaauguacaugcggauuugccuccaacaaaacgaucgagugugcuugcagagacaauagcuacaccgccaagcggccuuucgucaaacuuaacguggaaacagauaccgccgagauucgccugaugugcacagagaccuaucucgacacgcccagaccugaugacggcucuaucacagggcccugugaauccaauggagauaagggcagcgggggaaucaaaggcggcuuuguucaucaacggauggcuucuaagauugggcgcugguacagcagaaccauguccaaaaccaagcggaugggaaugggccuguaugugaaguacgacggggaccccuggacagauucugacgcgcuggcccucagcggagucaugguguccauggaggaaccuggcugguacagcuucggguuugagaucaaagauaagaaaugcgacgugccguguauuggcaucgaaaugguccacgauggaggcaaggagaccuggcauucugcugccacagccauuuauugccugaugggguccggacagcuucugugggacacgguuaccggcguggauauggcucucuga

SEQ ID NO: 211665 - RNA, 1401 nt, Artificial Sequence
  derived and/or modified sequence opt5 from neuraminidase__InfluenzaB__ABL76830
augcugcccagcaccauccagacacucacgcuguuccuuaccuccggcggggugcugcucucucuguacgucagcgccucccuuucuuaucugcucuacagcgacauucugcugaaguuuuccccuacaaaaaucaccgcuccgacaaugccccucgauugcgccaacgcgucuaauguucaagcugugaacagaagcgccaccaagggagugacacugcuucugccugagcccgaauggaccuauccucggcucuccugucccggcagcacguuccagaaagcccugcuuauuucuccucaccgcuuuggggagaccaagggaaauuccgcuccgcugaucauuagagaacccuucaucgccugcggcccuaaagaguguaagcauuuugcucucacacacuacgccgcgcagcccgggggauauuacaacggcacccggggcgaccgcaauaagcugagacaucugaucagcgucaaacucgggaagauuccuacaguggaaaacucuaucuuccacauggccgcuugguccggaagcgccugccaugauggcaaagaguggaccuauauugggguugacggacccgauaauaacgcucugcuuaagaucaaauacggcgaggccuacacggacacauaucacucuuacgcgaauaacauucugcggacccaggaauccgccuguaauugcaucgggggaaacuguuaucucaugauuacagauggcagcgcuuccggcgugucugagugccgcuuucugaagaucagagaagggcggaucauuaaggagaucuucccgaccggacgcgucaaacacaccgaggaauguacaugcggcuuugccagcaauaagacgauugagugugcuugcagagacaacuccuacaccgccaaacggccuuucgugaaacuuaauguugaaacagauaccgccgagauccgccugaugugcacaaagaccuaucucgacacgcccagaccugaugacgggagcauuacaggacccugugaaucuaacggcgauaagggguccggaggcaucaaaggcggguuugugcaucaacggauggcuagcaagaucggacgcugguacucuagaaccaugagcaagaccaaacggaugggcauggggcuguaugucaaguacgacggagaccccugggcggauuccgacgcccuggcucucucuggcgugauggugagcauggaggagccugggugguacuccuucggcuuugaaauuaaagauaagaaaugcgacgucccguguaucggaauugagaugguucacgauggcgggaaggaaacauggcauagcgccgccaccgcuaucuauugccugaugggaucuggccagcuucugugggacacagugacggggguggauauggcccucuga

SEQ ID NO: 211666 - RNA, 1401 nt, Artificial Sequence
  derived and/or modified sequence opt5 from neuraminidase__InfluenzaB__ABL76852
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcgugaagcacaccgaggaauguacaugcggauuugccuccaacaaaacgaucgagugugcuugcagagacaauagcuacaccgccaagcggccuuucgucaaacuuaacguggaaacagauaccgccgagauucgccugaugugcacagagaccuaucucgacacgcccagaccugaugacggcucuaucacagggcccugugaauccaauggagauaagggcagcgggggaaucaaaggcggcuuuguucaucaacggauggagucuaagauugggcgcugguacagcagaaccauguccaaaaccaagcggaugggaaugggccuguaugugaaguacgacggggaccccuggacagauucugacgcucuggcgcucagcggagucaugguguccaucgaggaaccuggcugguacagcuucggguuugaaauuaaagauaagaaaugcgacgugccguguaucggcauugagaugguccacgauggaggcaaggagaccuggcauucugccgcuacagccaucuauugccugaugggguccggacagcuucugugggacacgguuaccggcguggauauggcccucuga

SEQ ID NO: 211667 - RNA, 1401 nt, Artificial Sequence
  derived and/or modified sequence opt5 from neuraminidase__InfluenzaB__ABL76863
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcgugaagcacaccgaggaauguacaugcggauuugccuccaacaaaacgaucgagugugcuugcagagacaauagcuacaccgccaagcggccuuucgucaaacuuaacguggaaacagauaccgccgagauucgccugaugugcacagagaccuaucucgacacgcccagaccugaugacggcucuaucacagggcccugugaauccaauggagauaagggcagcgggggaaucaaaggcggcuuuguucaucaacggauggcuucuaagauugggcgcugguacagcagaaccauguccaaaaccaagcggaugggaaugggccuguaugugaaguacgacggggaccccuggacagauucugacgcgcuggcccucagcggagucaugguguccauggaggaaccuggcugguacagcuucggguuugagaucaaagauaagaaaugcgacgugccguguauuggcaucgaaaugguccacgauggaggcaaggagaccuggcauucugcugccacagccauuuauugccugaugggguccggacagcuucugugggacacgguuaccggcguggauauggcuauguga

SEQ ID NO: 211668 - RNA, 1401 nt, Artificial Sequence
  derived and/or modified sequence opt5 from neuraminidase__InfluenzaB__ABL76874
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagcuccgccaccaaaggagugacacugcuucugccugaacccgaguggaccuauccuagacucagcugucccggcucuacguuccagaaggcccugcuuauuuccccucaccgguuuggggaaaccaaaggaaauagcgcuccgcugaucauucgcgagcccuucaucgccugcggcccuaaggaauguaaacauuuugcucucacacacuacgccgcgcagcccgggggauauuacaacggcaccagaggcgaccggaauaagcugcgccaucugaucucugucaagcucgggaaaauuccuacaguggagaacuccaucuuccacauggccgcuuggagcggaucugccugccaugauggcaaggaguggaccuauauugggguugacggacccgauuccaaugcucugcuuaaaaucaaguacggcgaagccuacacggacacauaucacagcuacgcgaacaauauucugagaacccaggaguccgccuguaacugcaucgggggaaauuguuaucucaugauuacagauggcucugcuagcggcaucuccgaaugccgguuucugaaaauccgcgaggggagaauuaucaaggagauuuucccgaccggacgggugaagcacaccgaagaguguacaugcggcuuugccagcaacaaaacgaucgaaugugcuugccgcgacaauucuuacaccgccaagagaccuuucgucaaacuuaacguggagacagauaccgccgaaauuaagcugaugugcacagagaccuaucucgacacgccccggccugaugacggguccaucacaggacccugugagagcaauggcgauaaagggucuggaggcaucaagggcggguuuguucaucaacgcauggcuagcaaaauuggaagaugguacucccggaccaugucuaagaccaagcgcaugggcauggggcuguaugugaaauacgacggagaccccuggacagauagcgacgcgcuggcccucuccggcgucauggugagcauggaggaaccugggugguacucuuucggcuuugaaaucaaggauaaaaagugcgacgugccguguauuggaaucgagaugguccacgauggcgggaaagaaaccuggcauuccgcugccacagccauuuauugccugaugggaagcggccagcuucugugggacacgguuaccgggguggauauggcucucuga

SEQ ID NO: 211669 - RNA, 1401 nt, Artificial Sequence
  derived and/or modified sequence opt5 from neuraminidase__InfluenzaB__ABL76885
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauuaugccaacgcgucuaauguucaggcugugaacagaagcgccaccaaaggagugacacugcuucugcccgaaccugaguggaccuacccccggcucuccugcccuggcagcacguuccagaaggcccugcuuauuucuccccaccgcuuuggggaaaccaaaggaaauuccgcuccucugaucauuagagagccguucaucgccuguggccccaaggaaugcaaacauuuugcucucacacacuaugccgcgcagccugggggauacuauaacggcacccgggaggaccgcaauaagcugagacaucugaucagcgucaagcucggcaaaauucccacaguggagaacucuaucuuccacauggccgcuugguccgggagcgccugucaugauggacgggaauggaccuacauuggcguugacgggccugauucuaaugcucugcuuaagaucaaauacggagaggccuauacggacacauaccacuccuaugcgaagaacauucugcgcacccaagaaagcgccugcaauuguaucggcggggauugcuaccucaugauuacagacggauccgcuucuggcaucagcgaguguagauuucugaaaauccgggagggccgcauuaucaaggaaauuuuccccaccgggagagugaagcacaccgaggaaugcacauguggauuugccuccaacaaaacgaucgagugcgcuugucgggauaauagcuauaccgccaagcgcccguucgucaaacuuaacguggaaacagacaccgccgagauuagacugaugugcacagagaccuaccucgauacgccucggcccgacgauggcucuaucacagggccuugcgaauccaauggagacaagggcagcgggggaaucaaaggcggcuuuguucaucagcgcauggcuucuaagauugggagaugguauagccggaccauguccaaaaccaagagaaugggaaugggccuguacgugaaguacgacggggaucccuggacagacucugaggcgcuggcccucagcggagucaugguguccauggaggaacccggcugguauagcuucggguuugaaaucaaagauaagaaaugugacgugccuugcauuggcaucgagaugguccacgauggaggcaagaccacauggcauucugcugccacggccauuuacugucugaugggguccggacagcuucugugggacaccguuacaggcguggauauggcucucuga

SEQ ID NO: 211670 - RNA, 1401 nt, Artificial Sequence
  derived and/or modified sequence opt5 from neuraminidase__InfluenzaB__ABL76896
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggauguauccccggcucuccuguccuggcagcaccuuccagaaggcccugcuuauuucuccccaccgcuuuggggaaacgaaaggaaauuccgcuccucugaucauuagagagccguucaucgccugcggccccaaggaauguaaacauuuugcucucacccacuacgccgcgcagccugggggauauuacaacggcacacgggaggaccgcaauaagcugagacaucugaucagcgucaagcucggcaaaauucccaccguggagaacucuaucuuccacauggccgcuugguccgggagcgccugccaugauggacgggaauggacauauauuggcguugacgggccugauucuaaugcucugcuuaagaucaaauacggagaggccuacaccgacacguaucacuccuacgcgaagaacauucugcgcacacaagaaagcgccuguaauugcaucggcggggauuguuaucucaugauuaccgacggauccgcuucuggcaucagcgagugcagauuucugaaaauccgggagggccgcauuaucaaggaaauuuuccccacagggagagugaagcacaccgaggaauguaccugcggauuugccuccaacaaaacaaucgagugugcuugccgggauaauagcuacacggccaagcgcccguucgucaaacuuaacguggaaaccgacacagccgagauuagacugaugugcaccgagacauaucucgauaccccucggcccgacgauggcucuaucacggggccuugugaauccaauggagacaagggcagcgggggaaucaaaggcggcuuuguucaucagcgcauggcuucuaagauugggagaugguacagccggacaauguccaaaaccaagagaaugggaaugggccuguaugugaaguacgacggggaucccuggaccgacucugaggcgcuggcccucagcggagucaugguguccauggaggaacccggcugguacagcuucggguuugaaaucaaagauaagaaaugcgacgugccuuguauuggcaucgagaugguccacgauggaggcaagacaaccuggcauucugcugccacagccauuuauugccugaugggguccggacagcuucugugggacgcuguuacgggcguggauauggcccucuga

SEQ ID NO: 211671 - RNA, 1401 nt, Artificial Sequence
  derived and/or modified sequence opt5 from neuraminidase__InfluenzaB__ABL76918
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagagaccuaucucgacacgcccagaccugaugacgggagcauuacaggacccugugagucuaacggcgauaagggguccggaggcaucaagggcggguuugugcaucaacggauggcuagcaaaaucggacgcugguacucuagaaccaugagcaagaccgaacggaugggcauggggcuguaugucaaauacgacggagaccccugggcggauuccgacgcccuggcucucauuggcgugauggugucuauggaggaaccugggugguacagcuucggcuuugagaucaaggauaagaaaugcgacgucccguguauuggaaucgaaaugguucacgauggcgggaaggagacauggcauuccgccgccaccgcuauuuauugccugaugggaagcggccagcuucugugggacacagugacgggggugaauauggcccucuga

SEQ ID NO: 211672 - RNA, 1401 nt, Artificial Sequence
  derived and/or modified sequence opt5 from neuraminidase__InfluenzaB__ABL76962
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccaugucccuggauugcgccaacgcgucuaauguucaagcugugaaccacagcgccacagaggaaaugaccuuccuucugcccgagccugaauggacauaucccagacucuccugucagggaagcaccuuucagaaggcccugcuuaucucuccucaucgguucggcgaggcuaaaggaaauuccgcuccccugauuauccgcgaaccuuuuaucgccugcgggccgaaggaguguaaacacuucgcccucacgcauuacgcggcccagcccggcggguauuacaacggaaccagagaggaccggaauaagcugcgccaccugauuagcgugaaccucggcaagaucccuacagucgaaaauucuauuuuucauauggcugccugguccggcagcgcuugccacgaugggagagaguggaccuauaucggaguggacggccccgauucuaacgcccugauuaaaaucaaguacggggaagcguacacagacaccuaucacuccuacgccaauaacauucuucggacgcaagagagcgcuuguaauugcaucggaggcgauuguuaucugaugaucacagacggguccgccucuggaauuagcaaaugccgcuuccucaagaucagagagggccggauuaucaaagaaauuuuuccuaccggccgcguugagcauacagaagaguguaccugcggguucgcuuccaacaagaccaucgaaugugccugcagagauaauagcuacacagccaagcggcccuuugugaaacugaacgucgagacggacaccgcugagauccgccuuaugugcacagaaaccuaucuggauacaccgagaccugacgauggaucuauuaccggccccugugaguccaauggggacaagggaagcggcgggaucaaaggaggcuucgugcaccagcggauggcgucuaagauuggccgcugguacagcagaacgauguccaaaacaaagcggauggggauggaacucuauguuaaauacgacggagauccuuggaccgacucugaugcccuggcucccagcggcgugauggucuccauggaggaacccgggugguacagcuuuggauucgagaucaaggacaagaaaugcgaugugccuuguauuggcaucgagauggugcaugacgggggcaagaaaaccuggcacucugccgccacagcuaucuauugccugaugggauccggccagcuccugugggauaccgucacagggguugacauggcccuuuga

SEQ ID NO: 211673 - RNA, 1401 nt, Artificial Sequence; identical to SEQ ID NO: 211603
  derived and/or modified sequence opt5 from neuraminidase__InfluenzaB__ABL76973

SEQ ID NO: 211674 - RNA, 1401 nt, Artificial Sequence
  derived and/or modified sequence opt5 from neuraminidase__InfluenzaB__ABL76984
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaaccugagcgccaccaaaggagugacacuucugcuccccgaaccugaguggaccuaucccagacuguccuguccuggcagcacguuccagaaggcccuucugauuucuccccaccgguuuggggaaaccaaaggaaauuccgcuccucucaucauucgcgagccguucaucgccugcggccccaaggaauguaaacauuuugcucugacacacuacgccgcgcagccugggggauauuacaacggcaccagagaggaccggaauaagcugcgccaucucaucagcgucaagcugggcaaaauucccacaguggagaacucuaucuuccacauggccgcuugguccgggagcgccugccaugauggaagagaauggaccuauauuggcguugacgggccugauucuaaugcccuucugaagaucaaauacggagaggcuuacacggacacauaucacuccuacgcgaacaauauucuccggacccaagaaagcgccuguaacugcaucggcgggaauuguuaucugaugauuacagauggauccgcuucuggcaucagcgagugccgcuuucuuaagaucagagagggccggauuaucaaagaaauuuuccccaccgggcgcguggagcacaccgaagaguguacaugcggauuugccuccaacaagacgaucgaaugugcuugcagagacaauagcuacaccgccaagcggccguucgucaaacugaacguggagacagauaccgccgagauucgccucaugugcacagaaaccuaucuggacacgccuagacccgaugacggcucuaucacagggccuugugaguccaauggagauaagggcagcgggggaaucaaaggcggcuuuguucaucagcggauggcuucuaagauugggcgcugguacagcagaaccauguccaaaaccaagcggaugggaaugggccuguaugugaaauacgacggggaccccuggacagauucugacgcgcucgcccugagcggagucaugguguccauggaggaacccggcugguacagcuucggguuugaaaucaaggauaagaaaugcgacgugccuuguauuggcaucgagaugguccacgauggaggcaagagaaccuggcauucugcugccacagccauuuauugccuuaugggguccggacagcugcucugggacacgguuaccggcguggauauggcucuguga

SEQ ID NO: 211675 - RNA, 1401 nt, Artificial Sequence; identical to SEQ ID NO: 211630
  derived and/or modified sequence opt5 from neuraminidase__InfluenzaB__ABL77006

SEQ ID NO: 211676 - RNA, 1401 nt, Artificial Sequence; identical to SEQ ID NO: 211674
  derived and/or modified sequence opt5 from neuraminidase__InfluenzaB__ABL77017

SEQ ID NO: 211677 - RNA, 1401 nt, Artificial Sequence
  derived and/or modified sequence opt5 from neuraminidase__InfluenzaB__ABL77028
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcguggagcacaccgaagaguguacaugcggauuugccuccaacaagacgaucgaaugugcuugcagagacaauagcuacaccgccaaacggccuuucgucaaacuuaacguggagacagauaccgccgagauucgccugaugugcacagaaaccuaucucgacacgcccagaccugaugacggcucuaucacagggcccugugaguccaauggagauaagggcagcgggggaaucaagggcggcuuuguucaucaacggauggcuucuaaaauugggcgcugguacagcagaaccauguccaagaccaaacggaugggaaugggccuguaugugaaguacgacggggaccccuggacagauucugacgcgcuggcccucagcggagucaugguguccauggaggaaccuggcugguacagcuucggguuugaaaucaaggauaaaaagugcgacgugccguguauuggcaucgagaugguccacgauggaggcaaagagaccuggcauucugcugccacagccauuuauugccugaugggguccggacagcuucugugggacacgguuaccggcguggauauggcucucuga

SEQ ID NO: 211678 - RNA, 1401 nt, Artificial Sequence
  derived and/or modified sequence opt5 from neuraminidase__InfluenzaB__ABL77039
augcugcccagcaccauccagacacucacgcuguuccuuaccuccggcggggugcugcucucucuguacgucagcgccucccuuucuuaucugcucuacagcgacauucugcugaaguuuuccccuacagagaccacagcuccgaccaugccccucgauugcgccaacgcgucuaauguucaagcugugaacuguagcgccacaaaaggagugacccugcuucugccugaacccgaguggacguauccuagacucuccugccccggcagcaccuuccagaaggcccugcuuaucucuccucaccgguuuggggaaacaaaaggaaauuccgcuccgcugauuauccgcgagcccuucauugccuguggcccuaaggaaugcaaacauuuugcucucacccacuacgccgcgcagcccgggggauauuacaacggcacaagagaggaccggaauaagcugcgccaucugaucagcgucaagcucggcaaaaucccuaccguggagaacucuauuuuccacauggccgcuugguccgggagcgccugucaugauggaaaggaauggacguauaucggcguugacgggcccgauucuaaugcucugcuuaaaauuaaguacggagaggccuacacagacaccuaucacuccuacgcgaacaauauccugagaacacaggaaagcgccugcaacuguauuggcgggaauugcuaucucaugaucaccgauggauccgcuucuggcauuagcgagugucgguuucugaaaauccgcgagggcagaaucauuaaggaaaucuucccgaccgggcggguggagcacacagaagagugcacguguggauuugccuccaacaagaccauugaaugcgcuugccgcgacaauagcuacacagccaaaagaccuuucgucaaacuuaacguggagaccgauacagccgagauccggcugauguguaccgaaacguaucucgacacaccccgcccugaugacggcucuauuaccgggcccugcgaguccaauggagauaagggcagcgggggaaucaagggcggcuuuguucaucaaagaauggcuucuaaaaucgggcggugguacagccgcaccauguccaagacaaaaagaaugggaaugggccuguaugugaaguacgacggggaccccuggaccgauucugacgcgcuggcccucagcggagucaugguguccauggaggaaccuggcugguacagcuucggguuugaaauuaaggauaaaaagugugacgugccgugcaucggcauugagaugguccacgauggaggcaaagagacauggcauucugcugccacggccaucuauugucugaugggguccggacagcuucugugggacaccguuacaggcguggauauggcucucuga

SEQ ID NO: 211679 - RNA, 1401 nt, Artificial Sequence
  derived and/or modified sequence opt5 from neuraminidase__InfluenzaB__ABL77050
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaaggaauguaaacauuuugcccucacccacuacgcggcccagcccgggggauauuacaacggcacacgggaggaccgcaauaagcugagacaucugaucagcgucaagcucggcaaaauuccuaccguggagaacucuaucuuccacauggcugccugguccgggagcgcuugccaugauggaaaggaauggacauauauuggcguugacgggcccgauucuaaugcccugcuuaaaaucaaguacggagaggcguacaccgacacguaucacuccuacgccaacaauauucugcggacacaggaaagcgcuuguaacugcaucggcgggaauuguuaucucaugauuaccgauggauccgccucuggcaucagcgagugccgcuuucugaaaaucagagagggccggauuaucaaggaaauuuucccgacagggcgcgugaagcacaccgaggaauguaccugcggauuugcuuccaacaaaacaaucgagugugccugcagagacaauagcuacacggccaagcggccuuucgucaaacuuaacguggaaaccgauacagcugagauucgccugaugugcaccgagacauaucucgacacccccagaccugaugacggcucuaucacggggcccugugaauccaauggagauaagggcagcgggggaaucaaaggcggcuuuguucaucaacggauggcgucuaagauugggcgcugguacagcagaacaauguccaaaaccaagcggaugggaaugggccuguaugugaaguacgacggggaccccuggaccgauucugacgcccuggcucucagcggagucaugguguccauggaggaaccuggcugguacagcuucggguuugagaucaaagauaagaaaugcgacgugccguguauuggcaucgaaaugguccacgauggaggcaaggagacauggcauucugccgccaccgcuauuuauugccugaugggguccggacagcuucugugggacacaguuacgggcguggauauggcccucuga

SEQ ID NO: 211680 - RNA, 1401 nt, Artificial Sequence
  derived and/or modified sequence opt5 from neuraminidase__InfluenzaB__ABL77072
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggagagaguggacauauaucggagucgacggccccgauuccaacgcccugauuaagaucaaauacggggaggcguacaccgacacguaucacagcuacgccaauaacauucuucggacacaagaauccgcuugcaauuguaucggaggcgauugcuaucugaugaucaccgacgggucugccagcggaauuuccaagugucgcuuucucaaaaucagagagggccggauuaucaaggagauuuucccuacaggccgcguggaacauaccgaggaaugcaccuguggguuugcuagcaacaagacaaucgagugcgccuguagagauaauucuuacacggccaaacggcccuucguuaagcugaacguggaaaccgacacagcugagauccgccuuaugugcaccgagacauaucuggauaccccgagaccugacgauggauccauuacgggccccugcgaaagcaauggggacaaaggaucuggcgggaucaagggaggcuuuguccaccagcggauggcgagcaaaauuggccgcugguacuccagaacaaugucuaagaccaaacggauggggauggagcucuaugugaaguacgacggagauccuuggaccgacagcgaugcccuggcucccuccggcguuauggugagcaucaaggaaucugggugguacuccuucggauucgagauuaaagacaagaaaugugauguccccugcaucggcaucgaaauggugcaugacgggggcaagacaaccuggcacagcgccgccacagcuauuuauugucugaugggaucuggccagcuccugugggauacggugaccggggucgacauggcccuuuga

SEQ ID NO: 211681 - RNA, 1401 nt, Artificial Sequence; identical to SEQ ID NO: 211608
  derived and/or modified sequence opt5 from neuraminidase__InfluenzaB__ABL77083

SEQ ID NO: 211682 - RNA, 1401 nt, Artificial Sequence; identical to SEQ ID NO: 211608
  derived and/or modified sequence opt5 from neuraminidase__InfluenzaB__ABL77094

SEQ ID NO: 211683 - RNA, 1401 nt, Artificial Sequence
  derived and/or modified sequence opt5 from neuraminidase__InfluenzaB__ABL77105
augcugcccagcaccauccagacacucacgcuguuccuuaccuccggcggggugcugcucucucuguacgucagcgccucccuuucuuaucugcucuacagcgacauucugcugaaguuuuccucuacagagaucaccgcuccuacaaugccgcucgauugcgccaacgcgagcaauguucaagcugugaacagauccgccaccgaaggagugacacugcuucugcccgagccugaauggaccuauccccggcucagcuguccuggcucuacguuccagaaagcccugcuuauuagcccccaccgcuuuggggagaccaagggaaauuccgcuccucugaucauuagagaaccguucaucgccugcggccccaaagaguguaagcauuuugcucucacacacuacgccgcgcagccugggggauauuacaacggcacccgggaggaccgcaauaaacugagacaucugaucucugucaagcucggcaagauucccacaguggaaaacuccaucuuccacauggccgcuuggagcgggucugccugccaugauggaaaagaguggaccuauauuggcguugacgggccugauuccaaugcucugcuuaagaucaaauacggagaagccuacacggacacauaucacagcuacgcgaacaauauucugcggacccaggaguccgccuguaacugcaucggcgggaauuguuaucucaugauuacagauggaucugcuagcggcaucuccgagugccgcuuucugaagaucagagaaggccggauuaucaaagagauuuuccccaccgggcgcguggaacacaccgaggaauguacaugcggauuugccagcaacaagacgaucgagugugcuugcagagacaauucuuacaccgccaagcggccguucgucaaacuuaacguggagacagauaccgccgaaauucgccugaugugcacagagaccuaucucgacacgccuagacccgaugacggcuccaucacagggccuugugaaagcaauggagauaagggcucugggggaaucaaaggcggcuuuguucaucaacggauggcuagcaagauugggcgcugguacuccagaaccaugucuaaaaccaagcggaugggaaugggccuguaugugaaauacgacggggaccccuggacagauagcgacgcgcuggcccucuccggagucauggugagcauggaggaacccggcugguacucuuucggguuugagaucaaggauaagaaaugcgacgugccuuguauuggcaucgagaugguccacgauggaggcaaggaaaccuggcauuccgcugccacagccauuuauugccugauggggagcggacagcuucugugggacacgguuaccggcguggauauggcucucuga

SEQ ID NO: 211684 - RNA, 1401 nt, Artificial Sequence; identical to SEQ ID NO: 211608
  derived and/or modified sequence opt5 from neuraminidase__InfluenzaB__ABL77127

SEQ ID NO: 211685 - RNA, 1401 nt, Artificial Sequence
  derived and/or modified sequence opt5 from neuraminidase__InfluenzaB__ABL77138
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggagagaauggacauauaucggagucgacggccccgauuccaacgcccugauuaagaucaaauacggggaggcguacaccgacacguaucacagcuacgccaauaacauucuucggacacaagaauccgcuugcaauuguaucggaggcgauugcuaucugaugaucaccgacgggucugccagcggaauuuccaagugucgcuuucucaaaaucagagagggccggauuaucaaggagauuuucccuacaggccgcguggaacauaccgaggaaugcaccuguggguuugcuagcaacaagacaaucgagugcgccuguagagauaauucuuacacggccaaacggcccuucguuaagcugaacguggaaaccgacacagcugagauccgccuuaugugcaccgagacauaucuggauaccccgagaccugacgauggauccauuacgggccccugcgaaagcaauggggacaaaggaucuggcgggaucaagggaggcuuuguccaccagcggauggcgagcaaaauuggccgcugguacuccagaacaaugucuaagaccaaacggauggggauggagcucuaugugaaguacgacggagauccuuggaccgacagcgaugcccuggcucccuccggcguuauggugagcaucgaggagcccgggugguacucuuucggauucgaaauuaaggacaaaaagugugaugucccuugcaucggcaucgagauggugcaugacgggggcaaaacaaccugguauuccgccgccacagcuauuuacugucugaugggaagcggccagcuccugugggauacggugaccggggucgacauggcccuuuga

SEQ ID NO: 211686 - RNA, 1401 nt, Artificial Sequence; identical to SEQ ID NO: 211608
  derived and/or modified sequence opt5 from neuraminidase__InfluenzaB__ABL77149

SEQ ID NO: 211687 - RNA, 1401 nt, Artificial Sequence
  derived and/or modified sequence opt5 from neuraminidase__InfluenzaB__ABL77160
augcugcccagcaccauccagacacucacgcuguuccuuaccuccggcggggugcugcucucucuguacgucagcgccucccuuucuuaucugcucuacagcgacauucugcugaaguuuucccaaacaaaaaucaccgcuccuacaaugccgcucgauugcgccaacgcgucuaauguucaggcugugaacagaagcgccaccaagggagugacacugcuucugcccgagccugaauggaccuauccccggcucuccuguccuggcagcacguuccagaaagcccugcuuauuucuccccaccgcuuuggggagaccaagggaaauuccgcuccucugaucauuagagaaccguucaucgccugcggccccaaagaguguaagcauuuugcucucacacacuacgccgcgcagccugggggauauuacaacggcacccgggaagaccgcaauaagcugagacaucugaucagcgucaaacucggcaagauucccacaguggagaacucuaucuuccacauggccgcuugguccgggagcgccugccaugauggacgggaguggaccuauauuggcguugacgggccugauucuaaugcucugcuuaaaaucaaguacggagaagccuacacggacacauaucacuccuacgcgaaaaacauucugcgcacccaagagagcgccuguaauugcaucggcggggauuguuaucucaugauuacagacggauccgcuucuggcaucagcgaaugcagauuucugaagauccgggagggccgcauuaucaaggagauuuuccccaccgggagagugaaacacaccgaagaguguacaugcggauuugccuccaacaagacgaucgaaugugcuugccgggauaauagcuacaccgccaaacgcccguucgucaaacuuaacguggagacagacaccgccgaaauuagacugaugugcacagagaccuaucucgauacgccucggcccaaugacggcucuaucacagggccuugugaguccgauggagaccgcggcagcgggggaaucaagggcggcuuuguucaucagagaauggaaucuaagauugggcggugguacagcagaaccauguccaaaaccaagcgcaugggaaugggccuguaugugaaguacgacggggaucccuggacagacucugaggcucuggcgcucagcggagucaugguguccauggaggaacccggcugguacagcuucggguuugaaaucaaagauaagaaaugcgacgugccuuguauuggcaucgagaugguccacgauggaggcaagaccacauggcauucugccgcuacgaccauuuauugccugaugggguccggacagcuucugugggacacaguuaccggcguggauauggcccucuga

SEQ ID NO: 211688 - RNA, 1401 nt, Artificial Sequence; identical to SEQ ID NO: 211640
  derived and/or modified sequence opt5 from neuraminidase__InfluenzaB__ABL77171

SEQ ID NO: 211689 - RNA, 1401 nt, Artificial Sequence
  derived and/or modified sequence opt5 from neuraminidase__InfluenzaB__ABL77182
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggagagaauggacauauaucggagucgacggccccgauuccaacgcccugauuaagaucaaauacggggaggcguacaccgacacguaucacagcuacgccaauaacauucuucggacacaagaauccgcuugcaauuguaucggaggcgauugcuaucugaugaucaccgacgggucugccagcggaauuuccaagugucgcuuucucaaaaucagagagggccggauugugaaggagaucuucccuacaggccgcguugaacauaccgaggaaugcaccuguggguuugcuagcaacaagacaauugagugcgccuguagagauaauucuuacacggccaaacggcccuucgugaagcugaacgucgaaaccgacacagcugagauccgccuuaugugcaccgagacauaucuggauaccccgagaccugacgauggauccaucacgggccccugcgaaagcaauggggacaaaggaucuggcgggauuaagggaggcuuugugcaccagcggauggcgagcaaaaucggccgcugguacuccagaacaaugucuaagaccaaacggauggggauggagcucuauguuaaguacgacggagauccuuggaccgacagcgaugcccuggcucccuccggcgugauggucagcauugaggagcccgggugguacucuuucggauucgaaaucaaggacaaaaagugugaugugccuugcauuggcaucgagauggugcaugacgggggcaaaacaaccuggcacuccgccgccacagcuaucuauugucugaugggaagcggccagcuccugugggauacgauuaccggggucgacauggcccuuuga

SEQ ID NO: 211690 - RNA, 1401 nt, Artificial Sequence; identical to SEQ ID NO: 211615
  derived and/or modified sequence opt5 from neuraminidase__InfluenzaB__ABL77193

SEQ ID NO: 211691 - RNA, 1401 nt, Artificial Sequence
  derived and/or modified sequence opt5 from neuraminidase__InfluenzaB__ABL77204
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuuauuccugaacccgaguggaccuauccucggcuguccugucccggcagcacguuccagaaggcccuccugaucucuccucaccgcuuuggggaaaccaaaggaaauuccgcuccgcuuauuaucagagagcccuucaucgccugcggcccuaaggaauguaaacauuuugcucugacacacuacgccgcgcagcccgggggauauuacaacggcacccggggcgaccgcaauaagcucagacaucugauuagcgucaagcuggggaaaaucccuacaguggagaacucuauuuuccacauggccgcuugguccggaagcgccugccaugauggcaaggaguggaccuauaucgggguugacggacccgauaauucugcucuccugaaaauuaaguacggcgaagccuacacggacacauaucacuccuacgcgaacaauauccuucggacccaggagagcgccuguaacugcauugggggaaauuguuaucugaugaucacagauggcuccgcuucuggcgugagcgaaugccgcuuucucaaaaucagagaggggcggauuaucaaggagauuuucccgaccggacgcgucaagcacaccgaagaguguacaugcggcuuugccuccaacaaaacgaucgaaugugcuugcagagacaauagcuacaccgccaagcggccuuucgugaaacugaacguugagacagauaccgccgaaauucgccuuaugugcacagagaccuaucuggacacgcccagaccugaugacgggucuaucacaggacccugugaguccaauggcgauaaggggagcggaggcaucaaaggcggguuugugcaucaacggauggcuucuaagauuggacgcugguacagcagaaccauguccaaaaccaagcggaugggcauggggcucuaugucaaguacgacggagaccccugggcggauucugacgcccuggcucugagcggcgugaugguguccauggaggaaccugggugguacagcuucggcuuugaaaucaaagauaagaaaugcgacgucccguguauuggaaucgagaugguucacgauggcgggaaggaaacauggcauucugccgccaccgcuauuuauugccucaugggauccggccagcugcuuugggacacagugacggggguggauauggcccuguga

SEQ ID NO: 211692 - RNA, 1401 nt, Artificial Sequence
  derived and/or modified sequence opt5 from neuraminidase__InfluenzaB__ABL77215
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccuggcuuucucuggcgucauggugagcauggaggaaccugggugguacuccuuuggcuucgaaaucaaagauaagaaaugcgacgugccguguauuggaaucgagaugguccacgauggcgggaaggaaacauggcauagcgccgccaccgcuauuuauugccucaugggaucuggccagcugcuuugggacacaguuacgggggugaacauggcccuguga

SEQ ID NO: 211693 - RNA, 1401 nt, Artificial Sequence; identical to SEQ ID NO: 211651
  derived and/or modified sequence opt5 from neuraminidase__InfluenzaB__ABL77226

SEQ ID NO: 211694 - RNA, 1401 nt, Artificial Sequence
  derived and/or modified sequence opt5 from neuraminidase__InfluenzaB__ABL77237
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaucaacggauggcuagcaaaaucggacgcugguacucuagaaccaugagcaagaccgagcggaugggcauggggcuguaugucaaauacgacggagaucccugggcggacuccgaugcccuggcuuucucuggcgugauggugagcaugaaggaaccugggugguacuccuuuggcuucgagauuaaggacaaaaagugcgaugucccguguaucggaauugaaaugguucacgacggcgggaaagagacauggcauagcgccgccaccgcuaucuauugccucaugggaucuggccagcugcuuugggauacagugacggggguggacauggcccuguga

SEQ ID NO: 211695 - RNA, 1401 nt, Artificial Sequence
  derived and/or modified sequence opt5 from neuraminidase__InfluenzaB__ABL77248
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccaugucccuggauugcgccaacgcgucuaauguucaagcugccaaccacagcgccacaaaggagaugaccuuccuucugcccgaaccugaguggacauaucccagacucuccugucagggaagcaccuuucagaaagcucugcuuaucucuccucaucgguucggcgaagccaagggaaauuccgcuccccugauuauccgcgagccuuuuaucgccugcgggccgaaagaauguaagcacuucgcgcucacgcauuacgccgcucagcccggcggguauuacaacggaaccagagaggaccggaauaagcugcgccaccugauuagcgugaaccucggcaaaaucccuacaguggaaaauucuauuuuucauauggccgcuugguccggcagcgccugccacgaugggagagaguggaccuauaucggagucgacggccccgauucuaacgcgcugauuaagaucaaauacggggaggccuacacagacaccuaucacuccuacgcuaauaacauucuucggacgcaagaaagcgccuguaauugcaucggaggcgauuguuaucugaugaucacagacggguccgcuucuggaauuagcaagugccgcuuccucaaaaucagagagggccggauuaucaaggagauuuuuccuaccggccgcguggaacauacagaggaauguaccugcggguucgccuccaacaagaccaucgagugugccugcagagauaauagcuacacagcuaaacggcccuuuguuaagcugaacguggaaacggacaccgcggagauccgccuuaugugcacagagaccuaucuggauacaccgagaccugacgauggaucuauuaccggccccugugaauccaauggggagaaaggacggggcgggaucaagggaggcuucguccaccagcgcauggccagcaaaauuggcagaugguacucucggacgaugagcaagacagaaagaauggggauggagcucuaugugaaauacgacggagacccuuggaccgauuccgacgcucuggcccccucuggcguuauggugagcaugaaggaacccgggugguacuccuuuggauucgagaucaaggauaaaaagugcgacgucccuuguauuggcaucgagauggugcaugaugggggcaaaaagaccuggcacagcgccgcuacagccaucuauugccugaugggaucuggccagcuccugugggacaccgugacaggggucgauauggcgcuuuga

SEQ ID NO: 211696 - RNA, 1401 nt, Artificial Sequence
  derived and/or modified sequence opt5 from neuraminidase__InfluenzaB__ABL77259
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgaaaguuccccucgauugcgccaacgcgucuaaugugcaagcugugaacagaagcgccacaaagggaaugacccugcuucuguccgaaccugaguggacauauccccggcucagcugucagggcucuaccuuccagaaagcccugcuuauuuccccucaccgcuuuggggaaacgagaggaaauagcgcuccccugaucauucgggagccuuucaucgccugcggcccgaaggaauguaaacauuuugcucucacccacuacgccgcgcagcccgggggauauuacaacggcacacgcgaggacagaaauaagcugcggcaucugaucucugucaagcucggcaaaauuccuaccguggagaacuccaucuuccacauggccgcuuggagcgggucugccugccaugauggacgcgaauggacauauauuggcguugacgggcccgauuccaaugcucugaucaagauuaaauacggagaggccuacaccgacacguaucacagcuacgcgaacaauauccuuagaacacaagaauccgccuguaacugcauuggcggggauuguuaucugaugaucaccgacggaucugcuagcggcaucuccaagugccgguuucucaaaauucgcgagggcagaaucauuaaggagaucuucccuacagggcggguggaacacaccgaggaauguaccugcggauuugccagcaauaagacaauugagugugcuugccgcgauaacucuuacacggccaaaagacccuucgucaagcugaauguggaaaccgacacagccgagauccggcuuaugugcaccgagacauaucuggauaccccgcgcccugacgauggcuccaucacggggcccugugaaagcaacggagacaaaggcagagggggaauuaagggcggcuuuguucaucagcggauggcuucuaaaaucgggagaugguacagccgcacaauguccaagaccgagcggaugggaauggaacucuaugugaaauacgacggcgauccuuggaccgacucugaugcgcuggcccccagcggggucaugguguccaugaaggagcccggaugguacagcuucggcuuugaaauuaaggacaaaaagugcgaugugccuuguaucgggauugagaugguccacgacggcggcaaaaagacauggcauucugcugccaccgccaucuauugccugaugggauccgggcagcuccugugggauacaguuacgggaguggacauggcucuuuga

SEQ ID NO: 211697 - RNA, 1401 nt, Artificial Sequence
  derived and/or modified sequence opt5 from neuraminidase__InfluenzaB__ABL77270
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggaaugacacugcuucugccugaacccgaguggaccuauccucggcucuccugucccggcagcacguuccagaaggcccugcuuauuucuccucaccgcuuuggggaaaccagaggaaauuccgcuccgcugaucauucgggagcccuucaucgccugcggcccuaaagaauguaagcauuuugcucucacacacuacgccgcgcagcccgggggauauuacaacggcacccgcgaggacagaaauaaacugcggcaucugaucagcgugaagcucggcaagauuccuacagucgagaacucuaucuuccacauggccgcuugguccgggagcgccugccaugauggacgcgaauggaccuauauuggcguggacgggcccgauucuaaugcucugaucaaaauuaaguacggagaggccuacacggacacauaucacuccuacgcgaacaauauccuuagaacccaggaaagcgccuguaacugcauuggcggggauuguuaucugaugaucacagacggauccgcuucuggcaucagcaaaugccgguuucucaagauucgcgagggcagaaucauuaaagagaucuucccgaccgggcggguugaacacaccgaggaauguacaugcggauuugccuccaauaagacgauugagugugcuugccgcgauaacagcuacaccgccaagagaccuuucgugaaacugaaugucgaaacagacaccgccgagauccggcuuaugugcacagagaccuaucuggauacgccccgcccugacgauggcucuaucacagggcccugugaauccaacggagacaagggcagagggggaauuaaaggcggcuuugugcaucaacggauggcuagcaagaucgggagaugguacucucgcaccaugagcaaaaccgagcggaugggaauggaacucuauguuaaguacgacggcgaucccuggacagacuccgaggcgcuggccccuucuggggugauggucagcauggaggaaccgggaugguacuccuucggcuuugagauuaaagauaagaagugcgacgugcccuguaucgggauugaaauggugcacgauggcggcaaaaagaccuggcauagcgcugccacagccaucuauugccugaugggaucugggcagcuccugugggacacggucaccggaguugauauggcucuuuga

SEQ ID NO: 211698 - RNA, 1401 nt, Artificial Sequence
  derived and/or modified sequence opt5 from neuraminidase__InfluenzaB__ABL77281
augcugcccagcaccauccagacacucacgcuguuccuuaccuccggcggggugcugcucucucuguacgucagcguuucccuuucuuaucugcucuacagcgacauucugcugagauuuuccccuacagagaucaccgccccgacaaugccccucgauugcgcuaacgccucuaaugugcaagcggugaaccggagcgcuaccaagggaaugacacugcgccuuccugaacccgaguggaccuauccuagacuguccugucccggcagcacguuccagaaagcccuccugauuucuccucaccgguuuggggaaacccgcggaaauuccgccccgcuuaucauuagagagcccuucaucgcuugcggcccuaaggaauguaaacauuuugcccugacacacuacgcugcccagcccgggggauauuacaacggcacccgggaggaccgcaauaagcucagacaucugaucagcgucaaacugggcaagauuccuacaguggagaacucuaucuuccacauggcggccugguccgggagcgcuugccaugauggacgggaauggaccuauauuggcguugacgggcccgauucuaaugcccucaucaagauuaaauacggagaggcuuacacggacacauaucacuccuacgccaacaauauccugcgcacccaggaaagcgcguguaacugcauuggcggggauuguuaucuuaugaucacagacggauccgccucugagaucagcaagugcagauuucugaaaauucgggagggccgcaucauuaaggaaaucuucccgaccggcagaguggagcacaccgaagaguguacaugcggguuugcuuccaauaaaacgauugaaugugccugccgggauaacagcuacaccgcuaagcgcccuuucgucaagcucaauguggagacagacaccgccgagaucagacugaugugcacagaaaccuaucuugauacgccccggccugacgauggaucuaucacaggccccugugaguccaacggggacaaaggaagaggcgggauuaagggaggcuuuguucaucaacgcauggccagcaaaaucggccggugguacucuagaaccaugagcaagaccgaacgcauggggauggagcuguaugugaaauacgacggagaucccuggacagacuccgaagcucucgcgccuucuggcgucauggugagcauggaggagccggggugguacuccuucggauuugaaauuaaggauaaaaagugcgacgugcccuguaucggcauugagaugguccacgaugggggcaagaaaaccuggcauagcgccgcuacagccaucuauugccugaugggaucuggccagcugcucugggacacgguuaccgggguggauauggcccuguga

SEQ ID NO: 211699 - RNA, 1401 nt, Artificial Sequence
  derived and/or modified sequence opt5 from neuraminidase__InfluenzaB__ABL77292
augcugcccagcaccauccagacacucacgcuguuccuuaccuccggcggggugcugcucucucuguacgucagcgccucccuuucuuaucugcucuacagcggaguucugcugaaguuuuccccuacagagauuaccgcuccgacaaugccccucgacugcgccaacgcgucuaaugugcaagcugugaacagaagcgccaccaaaggcgucacacugcuucugccugaacccgaguggaccuauccucggcucuccugucccgggagcacguuccagaaggcccugcuuaucucuccucaccgcuuuggagaaaccagaggcaauuccgcuccgcugauuauccgggagcccuucauugccugcgggccuaaagaauguaagcauuuugcucucacacacuacgccgcgcagcccggaggcuauuacaacggcacccgcgaggauagaaauaaaaugcggcaucugaucagcgugaagcuggggaagaucccuacaguugagaacucuauuuuccacauggccgcuugguccggaagcgccugccaugacggccgcgaauggaccuauaucgggguggauggacccgacucuaaugcucucauuaaaaucaaguacggcgaggccuacacggauacauaucacuccuacgcgaacaauauucugagaacccaggaaagcgccuguaacugcaucgggggagacuguuaucuuaugauuacagauggcuccgcuucuggcaucagcaaaugccgguuucugaagauccgcgaggggagaauuaucaaagagauuuucccgaccggacgggucgaacacaccgaggaauguacaugcggcuuugccuccaauaagacgaucgagugugcuugccgcgacaacagcuacaccgccaagagaccuuucgugaaacucaauguugaaacagauaccgccgagauucggcugaugugcacagagaccuaucuugacacgccccgcccugaugacgggucuaucacaggacccugugaauccaacggcgauaaggggcugggaggcaucaaaggcggguuugugcaucaaagaauggcuagcaagauuggacggugguacucuagaaccaugagcaaaaccgagcgcaugggcauggaacucuaugucaaguacgacggggaccccuggacagauuccgacgcgcuggcccugucuggagugauggugagcauggaggaaccuggcugguacuccuucggguuugagaucaaagauaagaagugcgacgucccguguauuggcaucgagaugguucacgauggaggcaaaaagaccuggcauagcgcugccacagccauuuauugccucauggggucuggacagcugcuuugggacacggugaccggcguggauauggcucuguga

SEQ ID NO: 211700 - RNA, 1398 nt, Artificial Sequence
  derived and/or modified sequence opt5 from neuraminidase__InfluenzaB__ABL77303
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaucucccuggauugcgccaacgcgucuaauguucaagcugugaaccacagcgccaccaaggagaugacauuccuucugcccgaaccugaguggaccuaucccagacucuccugucagggaagcauuuuucagaaagcccugcuuaucucuccucaucgguucggcgaagcuaagggaaauuccgcuccccugaucauucgcgagccuuuuaucgccugcgggccgaaagaauguaagcacuucgcccucacacauuacgcggcccagcccggcggguauuacaacggaaccagagaggaccggaauaagcugcgccaccugauuagcgugaaccucggcaaaaucccuacggucgaaaauucuauuuuucauauggcugccugguccggcagcgcuugccacgaugggagagaguggaccuauaucggaguggacggccccgauucuaacgcccugauuaagaucaaauacggggaggcguacacagacaccuaucacuccuacgccaauaacauccuucggacacaagaaagcgcuuguaauugcauuggaggcgauuguuaucugaugaucaccgacggguccgccucuggaauuagcaagugccgcuuccucaaaaucagagagggccggauuaucaaggagaucuuuccuacgggccgcguugaacauacagaggaauguaccugcggguucgcuuccaacaagacaauugagugugccugcagagauaauagcuacaccgccaaacggcccuuugugaagcugaacgucgaaaccgacacagcugagauccgccuuaugugcacggagaccuaucuggauacaccgagaccugacgauggaucuauuaccggccccugugaauccaauggggacaaaggacggggcggggugaagggaggcuucguucaccagcgcaucgcgagcaaaauuggcagaugguacucucggacaaugagcaagaccgagagaauggggauggaacucuaugugaaauacgacggagauccuuggacggacuccgaugcccuggcucccucuggcgucauggugagcauggaggaacccgggugguacuccuuuggauucgagaucaaggacaagaaaugcgaugugccuuguaucggcauugagaugguccaugacgggggcaagaaaacauggcacagcgccgccaccgcuaucuauugccugaugggaucuggccagcuccugugggauaccguuacagggguggacauggcccuuuga

SEQ ID NO: 211701 - RNA, 1398 nt, Artificial Sequence
  derived and/or modified sequence opt5 from neuraminidase__InfluenzaB__ABL77314
augcugcccagcaccauccagacacucacgcuguuccuuaccuccggcggggugcugcucucucuguacgucagcgcccuucuguccuaucuccuguacucugacguucugcucaaguuuagcccuaaaauuaucgcuccgacaaugucccuggauugcgccaacgcgucuaaugugcaagcugugaaccacagcgccaccgaggaaaugacauuccuucugcccgagccugaauggaccuaucccagacucuccugucagggaagcacauuucagaaggcccugcuuauuucuccucaucgguucggcgaggcuaaaggaaauuccgcuccccugaucauucgcgaaccuuuuaucgccugcgggccgaaggaguguaaacacuucgcccucacccauuacgcggcccagcccggcggguauuacaacggaacgagagaggaccggaauaagcugcgccaccugaucagcgucaaccucggcaagauuccuaccguggaaaauucuaucuuucauauggcugccugguccggcagcgcuugccacgaugggagagaguggacauauauuggaguugacggccccgauucuaacgcccugaucaaaauuaaguacggggaagcguacaccgacacauaucacuccuacgccaauaacauccuucggacccaagagagcgcuuguaauugcauuggaggcgauuguuaucugaugaucacggacggguccgccucuggaaucagcaaaugccgcuuccucaagauuagagagggccggaucauuaaagaaaucuuuccuacaggccgcguggagcauaccgaagaguguacaugcggguucgcuuccaacaagaccauugaaugugccugcagagauaauagcuacaccgccaagcggcccuuugucaaacugaacguggagacagacacggcugagauccgccuuaugugcaccgaaacauaucuggauaccccgagaccugacgauggaucuaucacaggccccugugaguccaauggggacaagggacacggcgggauuaaaggaggcuucguucaucagcggauggcgagcaagaucggccgcugguacucuagaaccaugagcaaaacgaagcggauggggauggaacucuaugugaaauacgacggagauccuuggacagacuccgaugcccuggcucccucuggcgucauggugagcauggaggaacccgggugguacuccuuuggauucgagauuagagacaagaagugcgaugugccuuguaucggcauugagaugguccacgacgggggcaaaaagaccuggcacagcgccgccaccgcuaucuauugccugaugggaucuggccagcuccugugggauacaguuaccgggguggacauggcccuuuga

SEQ ID NO: 211702 - RNA, 1401 nt, Artificial Sequence
  derived and/or modified sequence opt5 from neuraminidase__InfluenzaB__ABL77325
augcugcccagcaccauccagacacucacgcuguuccuuaccuccggcggggugcugcucucucuguacgucagcgcccuucuguccuauucucucuacagcgacauucugcugaaguuuuccccuacaaaaaccaucgcuccgacaaugucucucgauugcgccaacgcgagcaauguucaagcugugaaccacuccgccaccaagggaaugacacugcuucugcccgagccugaauggaccuaucccagacucagcugucagggcucuacguuccagaaagcccugcuuauuuccccucaucgguuuggggagaccaagggaaauagcgcuccccugaucauucgcgaaccuuucaucgccugcggcccgaaagaguguaagcacuuugcucucacacauuacgccgcgcagcccgggggauauuacaacggcaccagagaagaccggaauaagcugcgccaccugaucucugugucccucggcaaaauuccuacagucgagaacagcaucuuccauauggccgcuuggucuggguccgccugccacgauggaagagaguggaccuauauuggcguggacgggcccgauagcaaugcucugaucaagauuaaauacggagaagccuacacggacacauaucacuccuacgcgaacaauauccuucggacccaagagucugccuguaacugcauuggcggggauuguuaucugaugaucacagacggaagcgcuuccggcaucagcaagugccgcuuucucaaaauuagagaaggccggaucauuaaggagaucuucccuaccgggcgcguugaucauaccgaggaauguacaugcggauuugccucuaauaagacgauugagugugcuugcagagacaacuccuacaccgccaaacggcccuucgugaagcugaaugucgaaacagauaccgccgagauccgccuuaugugcacagaaaccuaucuggacacgccgagaccugaugacggcagcaucacagggcccugugagucuaacggagacaaaggccgcgggggaauuaagggcggcuuugugcaccagcggauggcuagcaaaaucgggagaugguacucccggaccaugucuaagaccgagagacucggaauggaacuguauguuaaauacgauggcgacccuuggacagauagcgacgcgcuggcccccuccggggugauggucagcgcugaggaacccggaugguacucuuucggcuuugagauuaaggauaagaaaugcgacgugccuuguaucgggauugaaauggugcaugauggcggaaagaaaaccuggcacuccgccgccacagcuaucuauugccucaugggcagcgggcagcugcuuugggacacggucaccggaguugauauggcccuguga

SEQ ID NO: 211703 - RNA, 1401 nt, Artificial Sequence
  derived and/or modified sequence opt5 from neuraminidase__InfluenzaB__ABL77336
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgcccaugccucucgauugcgccaacgcgucuaauguucaagcugugaacagaagcgccacaaaaggagugacccugcuucugcccgaaccugaguggacauauccccggcucuccuguccuggcagcaccuuccagaaggcccugcuuauuucuccgcaccgcuuuggggaaacgagaggaaauuccgcuccccugaucauucgggagccuuucaucgccugcggccccaaagaauguaagcauuuugcuaucacccacuacgccgcgcagccugggggauauuacaacggcacacgcgaggacagaaauaaacuccggcaucugauuagcgucaagcugggcaagauccccaccguggagaacucuauuuuccacauggccgcuugguccgggagcgccugccaugauggacgcgaauggacauauaucggcguugacgggccggauucuaaugcucuccugaaaauuaaguacggagaggccuacaccgacacguaucacuccuacgcgaacaauauccuuagaacacaggaaagcgccuguaacugcauuggcggggauuguuaucugaugaucaccgacggauccgcuucuggcaucagcaaaugccgguuucucaagauucgcgagggcagaaucauuaaagagaucuucccuacagggcggguggaacacaccgaggaauguaccugcggauuugccuccaauaagacaauugagugugcuugccgcgauaacagcuacacggccaagagacccuucgucaaacugaauguggaaaccgacacagccgagauccggcuuaugugcaccgagacauaucuggauaccccucgccccgacgauggcucuaucacggggcccugugaauccaacggagacaagggcagagggggaauuaaaggcggcuuuguucaucaacggauggcuagcaagaucgggagaugguacucucgcacaaugagcaaaaccgaccggaugggaauggagcucuaugugaaguacgauggcgacccuuggaccgauuccgacgcgcuggcccugucuggggucauggugagcauggaggaaccgggaugguacuccuucggcuuugaaauuaaagauaagaagugcgacgugcccuguaucgggauugagaugguccacgauggcggcaaaaagacauggcauagcgcugccaccacaaucuauugccucaugggaucugggcagcugcuuugggacacgguuaccggaguggauauggcccuguga

SEQ ID NO: 211704 - RNA, 1401 nt, Artificial Sequence
  derived and/or modified sequence opt5 from neuraminidase__InfluenzaB__ABL77347
augcugcccagcaccauccagacacucacgcuguuccuuaccuccggcggggugcugcucucucuguacgucagcgccucccuuucuuaucugcucuacagcgacauucugcugaaguuuuccccuacaaaaaucaccgcuccgacaaugccccucgauugcgccaacgcgucuaauguucaagcugugaaccacagcgccaccaagggagugacacugcuucugccugagcccgaauggaccuauccuagacucuccugucccggcagcacguuccagaaagcccugcuuauuucuccucaucgguuuggggagacccgcggaaauuccgcuccgcugaucauuagagaacccuucaucgccugcggcccuaaggaguguaaacacuuugcucucacacauuacgccgcgcagcccgggggauauuacaacggcacccgggaagaccgcaauaagcugagacaccugaucagcgucaagcucggcaaaauuccuacaguggagaacucuaucuuccauauggccgcuugguccgggagcgccugccacgauggacgggaguggaccuauauuggcguugacgggcccgauucuaaugcucugcuuaagaucaaauacggagaagccuacacggacacauaucacuccuacgcgaacaauauucugcgcacccaggagagcgccuguaacugcaucggcggggauuguuaucucaugauuacagacggauccgcuucuggcaucagcgaaugcagauuucugaagauccgggagggccgcauuaucaaagagauuuucccgaccgggagaguggaacauaccgaggaauguacaugcggauuugccuccaauaagacgaucgagugugcuugccgggauaacagcuacaccgccaagcgcccuuucgucaaacuuaauguggaaacagacaccgccgagauuagacugaugugcacagagaccuaucucgauacgccccggccugacgauggcucuaucacagggcccugugaauccaacggagacaagggcagcgggggaaucaaaggcggcuuuguucaccaacgcauggcuucuaagauugggagaugguacagccggaccauguccaaaaccaagagaaugggaaugggccuguaugugaaauacgacggggaucccuggacagacucugaugcgcuggcccucagcggagucaugguguccauggaggaaccuggcugguacagcuucggguuugagaucaaggacaagaaaugcgaugugccguguauuggcaucgaaaugguccaugacggaggcaagaaaaccuggcacucugcugccacagccauuuauugccugaugggguccggacagcuucugugggauacgguuaccggcguggacauggcucucuga

SEQ ID NO: 211705 - RNA, 1398 nt, Artificial Sequence
  derived and/or modified sequence opt5 from neuraminidase__InfluenzaB__ABL77380
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaccucccuggauugcgccaacgcgucuaauguucaagcugugaaccacagcgccacaaaggagaugaaauuccuucccccugaacccgaguggaccuauccuagacuguccugucagggaagcacauuucagaaggcccuccugaucucuccccaucgguucggcgaagcuaaaggaaauuccgccccucuuauuauccgcgagccguuuaucgcuugcgggcccaaggaauguaagcacuucgcccugacccauuacgcggcccagccuggcggguauuacaacggaacgagagaggaccggaauaaacuccgccaccugauuagcgugaaccugggcaagauccccaccgucgaaaauucuauuuuucauauggcugccugguccggcagcgcuugccacgaugggagagaauggacauauaucggaguggacggcccugauucuaacgcccucauuaaaaucaaguacggggaggcguacaccgacacauaucacuccuacgccaauaacauucugcggacccaagaaagcgcuuguaauugcaucggaggcgauuguuaucuuaugaucacggacggguccgccucuggaauuagcaaaugccgcuuccugaagaucagagagggccggauuaucaaggagauuuuucccacaggccgcguugaacauaccgaggaauguacaugcggguucgcuuccaacaaaaccaucgagugugccugcagagauaauagcuacaccgccaagcggccguuugugaaacucaacgucgaaacagacacggcugagauccgccugaugugcaccgagacauaucuugauaccccuagacccgacgauggaucuauuacaggcccuugugaauccaauggggacaagggaagcggcggggugaaaggaggcuucguucaccagcggauggcgucuaagaucggccgcugguacagcagaaccauguccaaaacgaagcggauggggauggagcuguaugugaaguacgacggagaucccuggacagacucugaugcccucgcucccagcggcgucaugguguccauggaggagccugggugguacagcuuuggauucgaaauuaaagacaagaaaugcgaugugccguguaucggcauugagaugguccaugacgggggcaagagaaccuggcacucugccgccaccgcuaucuauugccugaugggauccggccagcugcucugggauacaguuaccggggugaacauggcccuguga

SEQ ID NO: 211706 - RNA, 1401 nt, Artificial Sequence
  derived and/or modified sequence opt5 from neuraminidase__InfluenzaB__ABL77391
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagagaccuaucucgacacgcccagaccugaugacgggagcauuacaggacccugugagucuaacggcgauaagggguccggaggcaucaaaggcggguuugugcaucaacggauggcuagcaagaucggacgcugguacucuagaaccaugagcaaaaccaagcggaugggcauggggcuguaugucaaguacgacggagaccccugggcggauuccgacgcccuggcucucucuggcgugauggugagcauggaggaaccugggugguacuccuucggcuuugaaauuaaagauaagaaaugcgacgucccguguaucggaauugagaugguucacgauggcgggaaggaaacauggcauagcgccgccaccgcuaucuauugccugaugggaucuggccagcuucugugggacacagugacggggguggauauggcccucuga

SEQ ID NO: 211707 - RNA, 1401 nt, Artificial Sequence
  derived and/or modified sequence opt5 from neuraminidase__InfluenzaB__ABL84344
augcugcccagcaccauccagacacucacgcuguuccuuaccuccggcggggugcugcucucucuguacgucagcgccucccuuucuuaucugcucuacagcgacauucugcugaaguuuuccucuacagagaucaccgcuccuacaaugccgcucaacugcgccaaugcgagcaacguucaagcugugaaucacuccgccaccaaaggagugacacugccccuuccugaacccgaguggaccuauccuagacugagcugucccggcucuacguuccagaaggcccuccugauuuccccucaucgguuuggggaaaccaaaggaaacagcgcuccgcuuaucauucgcgagcccuucaucgccugcggcccuaaggaauguaaacacuuugcucugacacauuacgccgcgcagcccgggggauauuacaauggcaccagagaggaucggaacaagcuccgccaccugaucucugucaagcugggcaaaauuccuacaguggaaaauuccaucuuccauauggccgcuuggagcgggucugccugccacgacggaagagaauggaccuauauuggcguugaugggcccgacuccaacgcucuccugaagaucaaauacggagaggccuacacggauacauaucacagcuacgcgaauaacauucuucggacccaggaauccgccuguaauugcaucggcggggacuguuaucugaugauuacagauggaucugcuagcggcguguccgagugccgcuuucucaagaucagagagggccggaucauuaaagaaaucuucccgaccgggcgcgucgagcauaccgaagaguguacaugcggauuugccagcaacaagacgauugaaugugcuugcagagacaauucuuacaccgccaagcggccuuucgugaaacugaacguugagacagauaccgccgagauccgccuuaugugcacagaaaccuaucuggacacgcccagaccugaugacggcuccauuacagggcccugugagagcaauggagauaagggcucugggggaaucaaaggcggcuuugugcaccaacggauggcuagcaagaucgggcgcugguacuccagaaccaugucuaaaaccaagcggaugggaaugggccucuaugucaaauacgacggggaccccuggauugauagcgacgcgcugacacuguccggagugauggugagcauggaggagccuggcugguacucuuucggguuugaaaucaaggauaagaaaugcgacgucccguguauuggcaucgagaugguucaugauggaggcaaggagaccuggcacuccgccgcuacagccauuuauugccucauggggagcggacagcugcuuugggacacggugaccggcguggauauggcccuguga

SEQ ID NO: 211708 - RNA, 1401 nt, Artificial Sequence
  derived and/or modified sequence opt5 from neuraminidase__InfluenzaB__ABN50397
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucaacugcgccaaugcgucuaacguucaagcugugaauagaagcgccaccaaaggagugacacugcuucugccugaacccgaguggaccuauccucggcucuccugucccggcagcacguuccagaaggcccugcuuauuucuccucaccgcuuuggggaaaccaaaggaaacuccgcuccgcugaucauuagagagcccuucaucgccugcggcccuaaggaauguaaacauuuugcucucacacacuacgccgcgcagcccgggggauauuacaauggcacccgggaggaucgcaacaagcugagacaucugaucagcgucaagcucggcaaaauuccuacaguggaaaauucuaucuuccacauggccgcuugguccgggagcgccugccaugacggacgggaauggaccuauauuggcguugaugggcccgacucuaacgcucugcuuaagaucaaauacggagaggccuacacggauacauaucacuccuacgcgaauaacauucugcgcacccaggaaagcgccuguaauugcaucggcggggacuguuaucucaugauuacagauggauccgcuucuggcaucagcgagugcagauuucugaagauccgggagggccgcauuaucaaagaaauuuucccgaccgggagaguggagcacaccgaagaguguacaugcggauuugccuccaacaagacgaucgaaugugcuugccgggacaauagcuacaccgccaagcgcccuuucgucaaacuuaacguggagacagauaccgccgagauuagacugaugugcacagaaaccuaucucgacacgccccggccugaugacggcucuaucacagggcccugugaguccaauggagauaagggcagcgggggaaucaaaggcggcuuuguucaucaacgcauggcuucuaagauugggagaugguacagccggaccauguccaaaaccaagagaaugggaaugggccuguaugugaaauacgacggggaccccuggaucgauucugacgcgcugacacucagcggagucaugguguccauggaggagccuggcugguacagcuucggguuugaaauuaaggauaagaaaugcgacgugccguguaucggcauugagaugguccacgauggaggcaagaaaaccuggcauucugccgcuacagccaucuauugccugaugggguccggacagcuucugugggacacgguuaccggcguggauauggaccucuga

SEQ ID NO: 211709 - RNA, 1401 nt, Artificial Sequence
  derived and/or modified sequence opt5 from neuraminidase__InfluenzaB__ABN50408
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucaacugcgccaaugcgucuaacguucaagcugugaauagaagcgccaccaaaggagugacacugccucuucccgaaccugaguggaccuauccccggcuguccuguccuggcagcacguuccagaaggcccuccugauuucuccgcaccgcuuuggggaaaccaaaggaaacuccgcuccccuuaucauuagagagccuuucaucgccugcggccccaaggaauguaaacauuuugcucugacacacuacgccgcgcagccugggggauauuacaauggcacccgggaggaucgcaacaagcucagacaucugaucagcgucaagcugggcaaaauucccacaguggaaaauucuaucuuccacauggccgcuugguccgggagcgccugccaugacggacgggaauggaccuauauuggcguugaugggccggacucuaacgcucuccugaagaucaaauacggagaggccuacacggauacauaucacuccuacgcgaauaacauucuucgcacccaggaaagcgccuguaauugcaucggcggggacuguuaucugaugauuacagauggauccgcuucuggcaucagcgagugcagauuucucaagauccgggagggccgcauuaucaaagaaauuuucccuaccgggagaguggagcacaccgaagaguguacaugcggauuugccuccaacaagacgaucgaaugugcuugccgggacaauagcuacaccgccaagcgccccuucgucaaacugaacguggagacagauaccgccgagauuagacuuaugugcacagaaaccuaucuggacacgccucggcccgaugacggcucuaucacagggcccugugaguccaauggagauaagggcagcgggggaaucaaaggcggcuuuguucaucaacgcauggcuucuaagauugggagaugguacagccggaccauguccaaaaccaagagaaugggaaugggccucuaugugaaauacgacggggacccuuggaucgauucugacgcgcugacacugagcggagucaugguguccauggaggagccgggcugguacagcuucggguuugaaauuaaggauaagaaaugcgacgugcccuguaucggcauugagaugguccacgauggaggcaagaaaaccuggcauucugccgcuacagccaucuauugccucaugggguccggacagcugcuuugggacacgguuaccggcguggauauggcccuguga

SEQ ID NO: 211710 - RNA, 1401 nt, Artificial Sequence
  derived and/or modified sequence opt5 from neuraminidase__InfluenzaB__ABN50419
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacugugugaguccaauggcgauaaggggagcggaggcaucaaaggcggguuuguucaucaacggauggcuucuaagauuggacgcugguacagcagaaccauguccaaaaccaagcggaugggcauggggcuguaugugaaguacgacggagaccccuggacagauucugacgcgcucgcccugagcggcgucaugguguccauggaggaacccgggugguacagcuucggcuuugaaaucaaagauaagaaaugcgacgugccuuguauuggaaucgagaugguccacgauggcgggaaggaaaccuggcauucugcugccacagccauuuauugccuuaugggauccggccagcugcucugggacacgguuaccgggguggauauggcucuguga

SEQ ID NO: 211711 - RNA, 1401 nt, Artificial Sequence
  derived and/or modified sequence opt5 from neuraminidase__InfluenzaB__ABN50430
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacccugugaguccaauggcgauaaggggagcggaggcaucaaaggcggguuuguucaucaacggauggcuucuaagauuggacgcugguacagcagaaccauguccaaaaccaagcggaugggcauggggcuguaugugaaguacgacggagaccccuggacagauucugacgcgcuggcccucagcggcgucaugguguccauggaggaaccugggugguacagcuucggcuuugaaaucaaagauaagaaaugcgacgugccguguauuggaaucgagaugguccacgauggcgggaaggaaaccuggcauucugcugccacagccauuuauugccugaugggauccggccagcuucugugggacacgguuaccgggguggauauggcucucuga

SEQ ID NO: 211712 - RNA, 1401 nt, Artificial Sequence; identical to SEQ ID NO: 211694
  derived and/or modified sequence opt5 from neuraminidase__InfluenzaB__ABN50463

SEQ ID NO: 211713 - RNA, 1401 nt, Artificial Sequence; identical to SEQ ID NO: 211608
  derived and/or modified sequence opt5 from neuraminidase__InfluenzaB__ABN50474

SEQ ID NO: 211714 - RNA, 1401 nt, Artificial Sequence
  derived and/or modified sequence opt5 from neuraminidase__InfluenzaB__ABN50485
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacccugugaguuuaauggcgauaagggguccggaggcaucaaaggcggguucguucaucaacggauggcuagcaagauuggacgcugguacucuagaaccaugagcaaaaccaagcggaugggcauggggcuguaugugaaguacgacggagaccccuggacagauuccgacgcgcuggcccucucuggcgucauggugagcauggaggaaccugggugguacuccuuuggcuucgaaaucaaagauaagaaaugcgacgugccguguauuggaaucgagaugguccacgauggcgggaaggaaaccuggcauagcgcugccacagccauuuauugccugaugggaucuggccagcuucugugggacacgguuaccgggguggauauggcucucuga

SEQ ID NO: 211715 - RNA, 1401 nt, Artificial Sequence
  derived and/or modified sequence opt5 from neuraminidase__InfluenzaB__ABN50496
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaacgggugacacugcuucugccugaacccgaguggaccuauccucgccucuccugucccggaagcacguuccagaaggcccugcuuauuucuccucacagauuuggcgaaaccaaaggaaauuccgcuccgcugaucauucgggagcccuucaucgccugcgggccuaaggaauguaaacauuuugcucucacacacuacgccgcgcagcccggcggguauuacaacggaacccgcggcgacagaaauaagcugcggcaucugaucagcgucaagcucggcaaaauuccuacaguggagaacucuaucuuccacauggccgcuugguccgggagcgccugccaugauggaaaggaguggaccuauauuggcguugacgggcccgauaauaacgcucugcuuaaaaucaaguacggagaagccuacacggacacauaucacucuuacgcgaauaacauucugcgcacccaggaguccgccuguaauugcaucggcgggaacuguuaucucaugauuacagauggaagcgcuuccggcgugucugaaugcagauuucugaaaauccgggagggccgcaucauuaaggagaucuucccgaccgggagaauuaagcacaccgaagaguguacaugcggauuugccagcaauaaaacgaucgaaugugcuugccgggacaacuccuacaccgccaagcgcccuuucgucaaacuuaauguggagacagauaccgccgaaauuagacugaugugcacagagaccuaucucgacacgccccggccugaugacggcagcaucacagggcccugugagucuaacggagauaagggcuccgggggaaucaaaggcggcuuuguucaucaacgcauggcuagcaagauugggagaugguacucucggaccaugagcaaaaccaagagaaugggaaugggccuguaugugaaguacgacggggaccccugggcggauuccgacgcccuggcuuucucuggagucauggugagcauggaggaaccuggcugguacuccuuuggguucgaaaucaaagauaagaaaugcgacgugccguguauuggcaucgagaugguccacgauggaggcaaggaaacauggcauagcgccgccaccgcuauuuauugccucauggggucuggacagcugcuuugggacacaguuacgggcgugaacauggcccuguga

SEQ ID NO: 211716 - RNA, 1401 nt, Artificial Sequence
  derived and/or modified sequence opt5 from neuraminidase__InfluenzaB__ABN50507
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucaacugcgccaaugcgucuaacguucaagcugugaauagaagcgccaccaaaggagugacacugccucuucccgaaccugaguggaccuauccccggcuguccuguccuggcagcacguuccagaaggcccuccugauuucuccgcaccgcuuuggggaaaccaaaggaaacuccgcuccccuuaucauuagagagccuuucaucgccugcggccccaaggaaugucggcauuuugcucugacacacuacgccgcgcagccugggggauauuacaauggcacccgcgaggauagaaacaaacuccggcaucugaucagcgucaagcugggcaagauucccacaguggaaaauucuaucuuccacauggccgcuugguccgggagcgccugccaugacggacgcgaauggaccuauauuggcguugaugggccggacucuaacgcucuccugaaaaucaaguacggagaggccuacacggauacauaucacuccuacgcgaauaacauucuuagaacccaggaaagcgccuguaauugcaucggcggggacuguuaucugaugauuacagauggauccgcuucuggcaucagcgagugccgguuucucaaaauccgcgagggcagaauuaucaaggaaauuuucccuaccgggcggguggagcacaccgaagaguguacaugcggauuugccuccaacaaaacgaucgaaugugcuugccgcgacaauagcuacaccgccaagagacccuucgucaagcugaacguggagacagauaccgccgagauucggcuuaugugcacagaaaccuaucuggacacgccucgccccgaugacggcucuaucacagggcccugugaguccaauggagauaaaggcagcgggggaaucaagggcggcuuuguucaucaaagaauggcuucuaaaauugggcggugguacagcagaaccauguccaagaccaaacgcaugggaaugggccucuaugugaaguacgacggggacccuuggaucgauucugacgcgcugacacugagcggagucaugguguccauggaggagccgggcugguacagcuucggguuugaaauuaaagauaagaagugcgacgugcccuguaucggcauugagaugguccacgauggaggcaaaaagaccuggcauucugccgcuacagccaucuauugccucaugggguccggacagcugcuuugggacacgguuaccggcguggauauggcccuguga

SEQ ID NO: 211717 - RNA, 1401 nt, Artificial Sequence; identical to SEQ ID NO: 211615
  derived and/or modified sequence opt5 from neuraminidase__InfluenzaB__ABN50518

SEQ ID NO: 211718 - RNA, 1401 nt, Artificial Sequence; identical to SEQ ID NO: 211615
  derived and/or modified sequence opt5 from neuraminidase__InfluenzaB__ABN50529

SEQ ID NO: 211719 - RNA, 1401 nt, Artificial Sequence; identical to SEQ ID NO: 211608
  derived and/or modified sequence opt5 from neuraminidase__InfluenzaB__ABN50540

SEQ ID NO: 211720 - RNA, 1401 nt, Artificial Sequence; identical to SEQ ID NO: 211640
  derived and/or modified sequence opt5 from neuraminidase__InfluenzaB__ABN50551

SEQ ID NO: 211721 - RNA, 1401 nt, Artificial Sequence
  derived and/or modified sequence opt5 from neuraminidase__InfluenzaB__ABN50562
augcugcccagcaccauccagacacucacgcuguuccuuaccuccggcggggcccugcucucucuguacgugagcgcccuucuguccuaucuccuguacucugacauucugcucaaguuuagcccuacaaaagucaucgccccgaccaugucccuggauuauacaaacgcgucuaauguucaagcugugaaccacagcgccaccgaggaaaugacauuccuucugcccgagccugaauggaccuaccccagacucuccugccagggaagcacguuucagaaggcccugcuuauuucuccucaucgguucggcgaggcuaaaggaaauuccgcuccccugaucauucgcgaaccuuuuaucgcuugugggccgaaggagugcaaacacuucgcccucacccauuaugcggcccagcccggcggguacuauaacggaacaagagaggaccggaauaagcugcgccaccugaucagcgugaaccucggcaagauuccuaccgucgaaaauucuaucuuucauauggcugccugguccggcagcgcuugucacgaugggagagaguggacauacauuggaguggacggccccgauucuaacgcccugaucaaaauuaaguacggggaagcguauaccgacacguaccacuccuaugccaauaacauccuucggacacaagagagcgcuugcaauuguauuggaggcgauugcuaccugaugaucaccgacggguccgccucuggaaucagccgcuguagauuccucaaaauucgggagggccgcaucauuaaggaaaucuuuccuacaggcagaguugagcauaccgaagagugcaccuguggguucgcuuccaacaaaacaauugaaugcgccugucgggauaauagcuauacggccaagcgccccuuugugaagcugaacgucgagaccgacacagcugagaucagacuuaugugcaccgaaacauaccuggauaccccgcggccugacgauggaucuaucacgggccccugcgaguccaauggggacaaaggaaacggcgggauuaagggaggcuucgugcaccagcgcauggcgagcagaaucggccggugguauucuagaacaaugagcaaaaccaagcgcauggggauggaacucuacguuaaauacgacggagauccuuggaccgacuccgaugcccuggcucccucuggcgugauggucagcauggaggaacccgggugguauuccuuuggauucgagauuaaggacaaaaagugugaugugccuugcaucggcauugagauggugcaugacgggggcaagaaaacauggcacagcgccgccaccgcuaucuacugucugaugggaucuggccagcuccugugggauacagucacggggguugacauggcccuuuga

SEQ ID NO: 211722 - RNA, 1401 nt, Artificial Sequence; identical to SEQ ID NO: 211711
  derived and/or modified sequence opt5 from neuraminidase__InfluenzaB__ABN50573

SEQ ID NO: 211723 - RNA, 1401 nt, Artificial Sequence
  derived and/or modified sequence opt5 from neuraminidase__InfluenzaB__ABN50584
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuucuacaaugccgcucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgaacaauauucugcggacccaggagagcgccuguaacugcaucgggggaaauuguuaucucaugauuacagauggcuccgcuucuggcgugagcgaaugccgcuuucugaagaucagagaggggcggaucauuaaagagaucuuccccaccggacgcgucaagcacaccgaagaguguacaugcggcuuugccuccaacaagacgauugaaugugcuugcagagacaauagcuacaccgccaaacggccguucgugaaacuuaacguugagucugauacagccgaaauccgccugaugugcaccgagacauaucucgacaccccuagacccgaugacggguccauuacgggaccuugugagagcaacggcgauaaggggucuggaggcaucaagggcggguuugugcaucaacggauggcuagcaaaaucggacgcugguacuccagaacaaugucuaagaccgaacggaugggcauggggcuguaugucaaauacgacggagaccccugggcggauagcgacgcccuggcucucuccggcgugauggugagcauggaggaacccgggugguacucuuucggcuuugagauuaaggauaagaaaugcgacgucccuuguaucggaauugaaaugguucacgauggcgggaaggagaccuggcauuccgccgccacagcuaucuauugccugaugggaagcggccagcuucugugggacaccgugacagggguggauauggcccucuga

SEQ ID NO: 211724 - RNA, 1401 nt, Artificial Sequence; identical to SEQ ID NO: 211608
  derived and/or modified sequence opt5 from neuraminidase__InfluenzaB__ABN50595

SEQ ID NO: 211725 - RNA, 1398 nt, Artificial Sequence
  derived and/or modified sequence opt5 from neuraminidase__InfluenzaB__ABN50606
augcugcccagcaccauccagacacucacgcuguuccuuaccuccggcggggugcugcucucucuguacgucagcgccucccuuucuuaucugcucuacagcgacauucugcugagauuuuccucuaagaucacagcuccuaccaugacacucgauugcgccaacgcgagcaauguucaagcugugaaccgguccgccaccaaagagaugacauuccugcuuccggaacccgaguggaccuauccucgccugagcugucagggaucuacguuucagaaggcccuccugauuucuccccacagauucggcgaagcucgggggaauagcgccccucuuaucauucgcgagcccuuuaucgcuugcggaccuaaagaauguaagcauuucgcccugacccacuacgcggcccagccgggcggguauuacaacggaacaagagaggaccggaauaaacuccgccaucugaucuccgugaagcugggcaagauucccaccgucgagaacuccaucuuucacauggcugccuggagcggcucugcuugccaugaugggagagaauggacauauauuggaguggacggcccugauuccaaugcccucaucaaaauuaaguacggggaggcguacaccgacacguaucacagcuacgccaacaauauccugcggacacaagaauccgcuuguaacugcauuggaggcgauuguuaucuuaugaucaccgacgggucugccagcggaaucuccgagugccgcuuccugaaaauuagagagggccggaucauuaaggaaaucuuucccacaggccgcguugagcacaccgaagaguguaccugcggguucgcuagcaauaaaacaauugaaugugccugcagagauaacucuuacacggccaagcggccuuuugugaagcucaaugucgagaccgacacagcugagauccgccugaugugcaccgaaacauaucuugauacccccagaccggacgauggauccaucacgggcccuugugagagcgacggggacaaaggacggggcgggauuaagggaggcuucgugcaucagagaauggcgucuaaaaucggccgcugguacagccggacaauguccaagaccgaaagaauggggauggagcuguauguuaaauacgauggagaccccuggaccgauucugacgcccucgcuccuagcggcgugauggucuccaugaaggaacccgggugguacagcuuuggauucgagauuaaagauaagaagugcgacgugcccuguaucggcauugagauggugcacgaugggggcaaaaagacauggcauucugccgccaccgcuaucuauugccugaugggauccggccagcugcucugggacacagucacggggguugauauggcccuguga

SEQ ID NO: 211726 - RNA, 1398 nt, Artificial Sequence
  derived and/or modified sequence opt5 from neuraminidase__InfluenzaB__ABN50628
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaugucccuggauugcgccaacgcgucuaauguucaagcugugaaccacagcgccaccaaggagaugacauuccuucugcccgaaccugaguggaccuaucccagacucuccugucagggaagcacauuucagaaagcccugcuuaucucuccucaucgguucggcgaagcuaagggaaauuccgcuccccugauuauccgcgagccuuuuaucgccugcgggccgaaagaauguaagcacuucgcccucacccauuacgcggcccagcccggcggguauuacaacggaacgagagaggaccggaauaagcugcgccaccugauuagcgugaaccucggcaaaaucccuaccgucgaaaauucuauuuuucauauggcugccugguccggcagcgcuugccacgaugggagagaguggacauauaucggaguggacggccccgauucuaacgcccugauuaagaucaaauacggggaggcguacaccgacacauaucacuccuacgccaauaacauucuucggacccaagaaagcgcuuguaauugcaucggaggcgauuguuaucugaugaucacggacggguccgccucuggaauuagcaagugccgcuuccucaaaaucagagagggccggauuaucaaggagauuuuuccuacaggccgcguugaacauaccgaggaauguacaugcggguucgcuuccaacaagaccaucgagugugccugcagagauaauagcuacaccgccaaacggcccuuugugaagcugaacgucgaaacagacacggcugagauccgccuuaugugcaccgagacauaucuggauaccccgagaccugacgauggaucuauuacaggccccugugaauccaauggggacaaaggacggggcggggugaagggaggcuucguucaccagcgcauggcgagcaaaaucggcagaugguacucucggaccaugagcaagacggagagaauggggauggaacucuaugugaaauacgacggagauccuuggacagacuccgaugcccuggcucccucuggcgucauggugagcauggaggaacccgggugguacuccuuuggauucgagauuaaggacaagaaaugcgaugugccuuguaucggcauugagaugguccaugacgggggcaagaaaaccuggcacagcgccgccaccgcuaucuauugccugaugggaucuggccagcuccugugggauacaguuaccgggguggacauggcccuuuga

SEQ ID NO: 211727 - RNA, 1398 nt, Artificial Sequence
  derived and/or modified sequence opt5 from neuraminidase__InfluenzaB__ABN50639
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaugucccuggauugcgccaacgcgucuaauguucaagcugugaaccacagcgccaccaaggagaugacauuccuucugcccgaaccugaguggaccuaucccagacucuccugucagggaagcacauuucagaaagcccugcuuaucucuccucaucgguucggcgaagcuaagggaaauuccgcuccccugauuauccgcgagccuuuuaucgccugcgggccgaaagaauguaagcacuucgcccucacccauuacgcggcccagcccggcggguauuacaacggaacgagagaggaccggaauaagcugcgccaccugauuagcgugaaacucggcaagaucccuaccgucgagaacucuauuuuucauauggcugccugguccggcagcgcuugccacgaugggagagaauggacauauaucggaguggacggccccgauucuaaugcccugguuaaaauuaaguacggggaggcguacaccgacacauaucacuccuacgccaacaauauccuucggacccaagaaagcgcuuguaacugcauuggaggcgauuguuaucugaugaucacggacggguccgccucuggaaucagcaaaugccgcuuccucaagauuagagagggccggaucauuaaggagaucuuuccuacaggccgcguggaacauaccgaggaauguacaugcggguucgcuuccaauaaaaccauugagugugccugcagagauaacagcuacaccgccaagcggcccuuugucaaacugaauguggaaacagacacggcugagauccgccuuaugugcaccgagacauaucuggauaccccgagaccugacgauggaucuaucacaggccccugugaauccaacggggacaagggacggggcgggguuaaaggaggcuucgugcaccagcgcauggcgagcaagauuggcagaugguacucucggaccaugagcaaaacggagagaauggggauggaacucuaugucaaguacgacggagauccuuggacagacuccgaugcccuggcucccucuggcgugauggugagcauggaggaacccgggugguacuccuuuggauucgagaucaaggacaaaaagugcgaugucccuuguauuggcaucgagaugguucaugacgggggcaaaaagaccuggcacagcgccgccaccgcuauuuauugccugaugggaucuggccagcuccugugggauacagugaccgggguggacauggcccuuuga

SEQ ID NO: 211728 - RNA, 1398 nt, Artificial Sequence
  derived and/or modified sequence opt5 from neuraminidase__InfluenzaB__ABN50650
augcugcccagcaccauccagacacucacgcuguuccuuaccuccggcggggugcugcucucucuguacgucagcgcccuucuguccuaucuccuguacucugacguucugcucaaguuuagcccuaaaauuaucgcuccgacaaugucccuggauugcgccaacgcgucuaaugugcaagcugugaaccacagcgccaccgaggaaaugacauuccuucugcccgagccugaauggaccuaucccagacucuccugucagggaagcacauuucagaaggcccugcuuauuucuccucaucgguucggcgaggcuaaaggaaauuccgcuccccugaucauucgcgaaccuuuuaucgccugcgggccgaaggaguguaaacacuucgcccucacccauuacgcggcccagcccggcggguauuacaacggaacgagagaggaccggaauaagcugcgccaccugaucagcgucaaccucggcaagauuccuaccguggaaaauucuaucuuucauauggcugccugguccggcagcgcuugccacgaugggagagaguggacauauauuggaguugacggccccgauucuaacgcccugaucaaaauuaaguacggggaagcguacaccgacacauaucacuccuacgccaauaacauccuucggacccaagagagcgcuuguaauugcauuggaggcgauuguuaucugaugaucacggacggguccgccucuggaaucagcaaaugccgcuuccucaagauuagagagggccggaucauuaaagaaaucuuuccuacaggccgcguggagcauaccgaagaguguacaugcggguucgcuuccaacaagaccauugaaugugccugcagagauaauagcuacaccgccaagcggcccuuugucaaacugaacguggagacagacacggcugagauccgccuuaugugcaccgaaacauaucuggauaccccgagaccugacgauggaucuaucacaggccccugugaguccaauggggacaagggacacggcgggauuaaaggaggcuucguucaucagcggauggcgagcaagaucggccgcugguacucuagaaccaugagcaaaacgaagcggauggggauggaacucuaugugaaauacgacggagauccuuggacagacuccgaugcccuggcucccucuggcgucauggugagcauggaggaacccgggugguacuccuuuggauucgagauuaaggacaagaaaugcgaugugccuuguaucggcauugagaugguccacgacgggggcaagaaaaccuggcacagcgccgccaccgcuaucuauugccugaugggaucuggccagcuccugugggauacaguuaccgggguggacauggcccuuuga

SEQ ID NO: 211729 - RNA, 1398 nt, Artificial Sequence
  derived and/or modified sequence opt5 from neuraminidase__InfluenzaB__ABN50661
augcugcccagcaccauccagacacucacgcuguuccuuaccuccggcggggugcugcucucucuguacgucagcgcccuucuguccuaucuccuguacucugacguucugcucaaguuuagcccuaaaaugauugcuccgacaaugucccuggauugcgccaacgcgucuaaugugcaagcugugaaccacagcgccaccgaggaaaugacauuccuucugcccgagccugaauggaccuaucccagacucuccugucagggaagcacauuucagaaggcccugcuuaucucuccucaucgguucggcgaggcuaaaggaaauuccgcuccccugauuauccgcgaaccuuuuauugccugcgggccgaaggaguguaaacacuucgcccucacccauuacgcggcccagcccggcggguauuacaacggaacgagagaggaccggaauaagcugcgccaccugaucagcgucaaccucggcaagaucccuaccguggaaaauucuauuuuucauauggcugccugguccggcagcgcuugccacgaugggagagaguggacauauaucggaguugacggccccgauucuaacgcccugauuaaaaucaaguacggggaagcguacaccgacacauaucacuccuacgccaauaacauucuucggacccaagagagcgcuuguaauugcaucggaggcgauuguuaucugaugauuacggacggguccgccucuggaaucagcaaaugccgcuuccucaagaucagagagggccggauuaucaaagaaauuuuuccuacaggccgcguggagcauaccgaagaguguacaugcggguucgcuuccaacaagaccaucgaaugugccugcagagauaauagcuacaccgccaagcggcccuuugucaaacugaacguggagacagacacggcugagauucgccuuaugugcaccgaaacauaucuggauaccccgagaccugacgauggaucuaucacaggccccugugaguccaauggggacaagggacacggcgggaucaaaggaggcuucguucaucagcggauggcgagcaagauuggccgcugguacucuagaaccaugagcaaaacgaagcggauggggauggaacucuaugugaaauacgacggagauccuuggacagacuccgaugcccuggcucccucuggcgucauggugagcauggaggaacccgggugguacuccuuuggauucgagaucaaggacaagaaaugcgaugugccuuguauuggcaucgagaugguccacgacgggggcaagaaaaccuggcacagcgccgccaccgcuauuuauugccugaugggaucuggccagcuccugugggauacaguuaccgggguggacauggcccuuuga

SEQ ID NO: 211730 - RNA, 1401 nt, Artificial Sequence
  derived and/or modified sequence opt5 from neuraminidase__InfluenzaB__ABN50683
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccagaggaaauuccgcuccgcugaucauucgggagcccuucaucgccugcggcccuaaagaauguaagcauuuugcucucacacacuacgccgcgcagcccgggggauauuacaacggcacccgcgaggacagaaauaaacugcggcaucugaucagcgucaagcucggcaagauuccuacaguggagaacucuaucuuccacauggccgcuugguccgggagcgccugccaugauggacgcgaauggaccuauauuggcguugacgggcccgauucuaaugcucugcuuaaaaucaaguacggagaggccuacacggacacauaucacuccuacgcgaacaauauucugagaacccaggaaagcgccuguaacugcaucggcggggauuguuaucucaugauuacagacggauccgcuucuggcaucagcaaaugccgguuucugaagauccgcgagggcagaauuaucaaagagauuuucccgaccgggcggguggaacacaccgaggaauguacaugcggauuugccuccaauaagacgaucgagugugcuugccgcgauaacagcuacaccgccaagagaccuuucgucaaacuuaauguggaaacagacaccgccgagauucggcugaugugcacagagaccuaucucgauacgccccgcccugacgauggcucuaucacagggcccugugaauccaacggagacaagggccucgggggaaucaaaggcggcuuuguucaucaaagaauggcuagcaagauugggcggugguacucuagaaccaugagcaaaaccaagcgcaugggaauggagcuguaugugaaauacgacggcgaucccuggacagacuccgaugcgcuggcccugucuggggucauggugccuauggaggaaccgggaugguacagcuucggcuuugaaaucaaggacaagaaaugcgaugugcccuguauugggaucgagaugguccacgacggcggaaagaaaaccuggcauuccgcugccacagccauuuauugccuuaugggcagcgggcagcugcucugggauacgguuaccggaguggacauggcucuguga

SEQ ID NO: 211731 - RNA, 1401 nt, Artificial Sequence
  derived and/or modified sequence opt5 from neuraminidase__InfluenzaB__ABN50694
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccagaggaaauuccgcuccgcugaucauucgggagcccuucaucgccugcggcccuaaagaauguaagcauuuugcucucacacacuacgccgcgcagcccgggggauauuacaacggcacccgcgaggacagaaauaaacugcggcaucugaucagcgucaagcucggcaagauuccuacaguggagaacucuaucuuccacauggccgcuugguccgggagcgccugccaugauggacgcgaauggaccuauauuggcguugacgggcccgauucuaaugcucugcuuaaaaucaaguacggagaggccuacacggacacauaucacuccuacgcgaacaauauucugagaacccaggaaagcgccuguaacugcaucggcggggauuguuaucucaugauuacagacggauccgcuucuggcaucagcaaaugccgguuucugaagauccgcgagggcagaauuaucaaagagauuuucccgaccgggcggguggaacacaccgaggaauguacaugcggauuugccuccaauaagacgaucgagugugcuugccgcgauaacagcuacaccgccaagagaccuuucgucaaacuuaauguggaaacagacaccgccgagauucggcugaugugcacagagaccuaucucgauacgccccgcccugacgauggcucuaucacagggcccugugaauccaacggagacaagggcagcgggggaaucaaaggcggcuuuguucaucaaagaauggcuucuaagauugggcggugguacagcagaaccauguccaaaaccaagcgcaugggaaugggccuguaugugaaauacgacggggaucccuggacagacucugaugcgcuggcccucagcggagucaugguguccauggaggaaccuggcugguacagcuucggguuugagaucaaggacaagaaaugcgaugugccguguauuggcaucgaaaugguccacgacggaggcaagaaaaccuggcauucugcugccacagccauuuauugccugaugggguccggacagcuucugugggauacgguuaccggcguggacauggcucucuga

SEQ ID NO: 211732 - RNA, 1398 nt, Artificial Sequence
  derived and/or modified sequence opt5 from neuraminidase__InfluenzaB__ABN50705
augcugcccagcaccauccagacacucacgcuguuccuuacccugggcggggugcuccugucccuuuacgucucugcccugcucagcuaucugcuguacuccgacguucuccugaaguuuucuccuaaaaugauugcuccgacaaugagccuugauugcgccaacgcguccaaugugcaagcugugaaccacucugccaccgaggaaaugacauuccugcuccccgagccugaauggaccuaucccagacugagcugucagggauccacauuucagaaggcccuucugaucagcccucaucgguucggcgaggcuaaaggaaauucugcuccccucauuauccgcgaaccuuuuauugccugcgggccgaaggaguguaaacacuucgcccugacccauuacgcggcccagcccggcggguauuacaacggaacgagagaggaccggaauaagcugcgccaccucaucuccgucaaccugggcaagaucccuaccguggaaaauagcauuuuucauauggcugccuggucuggcuccgcuugccacgaugggagagaguggacauauaucggaguugacggccccgauagcaacgcccuuauuaaaaucaaguacggggaagcguacaccgacacauaucacucuuacgccaauaacauucugcggacccaagaguccgcuuguaauugcaucggaggcgauuguuaucucaugauuacggacgggagcgccuccggaaucucuaaaugccgcuuccugaagaucagagagggccggauuaucaaagaaauuuuuccuacaggccgcguggagcauaccgaagaguguacaugcggguucgcuagcaacaagaccaucgaaugugccugcagagauaauuccuacaccgccaagcggcccuuugucaaacuuaacguggagacagacacggcugagauucgccugaugugcaccgaaacauaucucgauaccccgagaccugacgauggaagcaucacaggccccugugagucuaauggggacaagggacacggcgggaucaaaggaggcuucguucaucagcggauggcguccaagauuggccgcugguacagcagaaccaugucuaaaacgaagcggauggggauggaacuguaugugaaauacgacggagauccuuggacagacagcgaugcccuggcucccuccggcgucauggugucuauggaggaacccgggugguacagcuuuggauucgagaucaaggacaagaaaugcgaugugccuuguauuggcaucgagaugguccacgacgggggcaagaaaaccuggcacuccgccgccaccgcuauuuauugccucaugggaagcggccagcugcuuugggauacaguuaccgggguggacauggcccuguga

SEQ ID NO: 211733 - RNA, 1401 nt, Artificial Sequence
  derived and/or modified sequence opt5 from neuraminidase__InfluenzaB__ABN50716
augcugcccagcaccauccagacacucacgcuguuccuuaccuccggcggggugcugcucucucuguacgucagcgccucccuuucuuaucugcucuacagcggcauucugcugaaguuuuccccuacagagaucaccgcuccgacaaugccccucgacugcgccaacgcgucuaauguucaagcugugaacagaagcgccaccaaaggagugacacugcuucugccugaacccgaguggaccuauccucggcucuccugucccgggagcacguuccagaaggcccugcuuauuucuccucaccgcuuuggagaaaccagaggcaauuccgcuccgcugaucauucgggagcccuucaucgccugcgggccuaaagaauguaagcauuuugcucucacacacuacgccgcgcagcccggaggcuauuacaacggcacccgcgaggauagaaauaaacugcggcaucugaucagcgucaagcucgggaagauuccuacaguggagaacucuaucuuccacauggccgcuugguccggaagcgccugccaugacggccgcgaauggaccuauauugggguugauggacccgacucuaaugcucugcuuaaaaucaaguacggcgaggccuacacggauacauaucacuccuacgcgaacaauauucugagaacccaggaaagcgccuguaacugcaucgggggagacuguuaucucaugauuacagauggcuccgcuucuggcaucagcaaaugccgguuucugaagauccgcgaggggagaauuaucaaagagauuuucccgaccggacggguggaacacaccgaggaauguacaugcggcuuugccuccaauaagacgaucgagugugcuugccgcgacaacagcuacaccgccaagagaccuuucgucaaacuuaauguggaaacagauaccgccgagauucggcugaugugcacagagaccuaucucgacacgccccgcccugaugacgggucuaucacaggacccugugaauccaacggcgauaaggggagcggaggcaucaaaggcggguuuguucaucaaagaauggcuucuaagauuggacggugguacagcagaaccauguccaaaaccaagcgcaugggcauggggcuguaugugaaauacgacggagaccccuggacagauucugacgcgcuggcccucagcggcgucaugguguccauggaggaaccugggugguacagcuucggcuuugagaucaaggauaagaaaugcgacgugccguguauuggaaucgaaaugguccacgauggcgggaagaaaaccuggcauucugcugccacagccauuuauugccugaugggauccggccagcuucugugggacacgguuaccgggguggauauggcucucuga

SEQ ID NO: 211734 - RNA, 1401 nt, Artificial Sequence
  derived and/or modified sequence opt5 from neuraminidase__InfluenzaB__ABN50727
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggacgggaauggaccuauauuggcguugacgggcccgauucuaaugcucugcuuaagaucaaauacggagaggccuacacggacacauaucacuccuacgcgaacaauauucugcgcacccaggaaagcgccuguaacugcaucggcggggauuguuaucucaugauuacagacggauccgcuucuggcaucagcgagugcagauuucugaagauccgggagggccgcauuaucaaagaaauuuucccgaccgggagaguggagcacaccgaagaguguacaugcggauuugccuccaauaagacgaucgaaugugcuugccgggauaacagcuacaccgccaagcgcccuuucgucaaacuuaauguggagacagacaccgccgagauuagacugaugugcacagaaaccuaucucgauacgccccggccugacgauggcucuaucacagggcccugugaguccaacggagacaagggcagcgggggaaucaaaggcggcuuuguucaucaacgcauggcuucuaagauugggagaugguacagccggaccauguccaaaaccaagagaaugggaaugggccuguaugugaaauacgacggggaucccuggacagacucugaugcgcuggcccucagcggagucaugguguccauggaggaaccuggcugguacagcuucggguuugaaaucaaggacaagaaaugcgaugugccguguauuggcaucgagaugguccacgacggaggcaagaaaaccuggcauucugcugccacagccauuuauugccugaugggguccggacagcuucugugggauacgguuaccggcguggacauggcucucuga

SEQ ID NO: 211735 - RNA, 1401 nt, Artificial Sequence; identical to SEQ ID NO: 211677
  derived and/or modified sequence opt5 from neuraminidase__InfluenzaB__ABN50738

SEQ ID NO: 211736 - RNA, 1401 nt, Artificial Sequence
  derived and/or modified sequence opt5 from neuraminidase__InfluenzaB__ABN50749
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacccugugaguccaauggcgauaaggggagcggaggcaucaaaggcggguuuguucaucaacggauggcuucuaagauuggacgcugguacagcagaaccauguccaaaaccaagcggaugggcauggggcuguaugugaaguacgacggagaccccugggcggauucugacgcccuggcucucagcggcgucaugguguccauggaggaaccugggugguacagcuucggcuuugaaaucaaagauaagaaaugcgacgugccguguauuggaaucgagaugguccacgauggcgggaaggaaacauggcauucugccgccaccgcuauuuauugccugaugggauccggccagcuucugugggacacaguuacggggguggauauggcccucuga

SEQ ID NO: 211737 - RNA, 1398 nt, Artificial Sequence
  derived and/or modified sequence opt5 from neuraminidase__InfluenzaB__ABN51188
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaugcugcuugauugcgccaacgcguccaauguucaagcugugaaccacucugccaccaaggagaugacauuccugcuccccgaaccugaguggaccuaucccagacugagcugucagggauccacauuucagaaagcccuucugaucagcccucaucgguucggcgaagcuaagggaaauucugcuccccucauuauccgcgagccuuuuaucgccugcgggccgaaagaauguaagcacuucgcccugacccauuacgcggcccagcccggcggguauuacaacggaacgagagaggaccggaauaagcugcgccaccucauuuccgugaaccugggcaaaaucccuaccgucgagaauagcauuuuucauauggcugccuggucuggcuccgcuugccacgaugggagagaauggacauauaucggaguggacggccccgauagcaacgcccuuauuaagaucaaauacggggaggcguacaccgacacauaucacucuuacgccaauaacauucugcggacccaagaauccgcuuguaauugcaucggaggcgauuguuaucucaugaucacggacgggagcgccuccggaauuucuaagugccgcuuccugaaaaucagagagggccggauuaucaaggagauuuuuccuacaggccgcguugaacauaccgaggaauguacaugcggguucgcuagcaacaagaccaucgagugugccugcagagauaauuccuacaccgccaaacggcccuuugugaaacuuaacgucgaaacagacacggcugagauccgccugaugugcaccgagacauaucucgauaccccgagaccugacgauggaagcauuacaggccccugugaaucuaauggggacaagggacggggcggggugaagggaggcuucguucaccagcgcauggcguccaaaaucggcagaugguacagccggaccaugucuaagacggagagaauggggauggaacuguaugugaaauacgacggagauccuuggacagacagcgaugcccuggcucccuccggcgucauggugucuauggaggaacccgggugguacagcuuuggauucgagauuaaggacaagaaaugcgaugugccuuguaucggcauugagaugguccaugacgggggcaagaaaaccuggcacuccgccgccaccgcuaucuauugccucaugggaagcggccagcugcuuugggauacaguuaccgggguggacauggcccuguga

SEQ ID NO: 211738 - RNA, 1398 nt, Artificial Sequence; identical to SEQ ID NO: 211726
  derived and/or modified sequence opt5 from neuraminidase__InfluenzaB__ABN51199

SEQ ID NO: 211739 - RNA, 1401 nt, Artificial Sequence
  derived and/or modified sequence opt5 from neuraminidase__InfluenzaB__ABN58665
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccaugucccuggauugcgccaacgcgucuaauguucaagcugugaaccacagcgccacagaggaaaugaccuuccuucugcccgagccugaauggacauaucccagacucuccugucagggaagcaccuuucagaaggcccugcuuaucucuccucaucgguucggcgaggcuaaaggaaauuccgcuccccugauuauccgcgaaccuuuuaucgccugcgggccgaaggaguguaaacacuucgcccucacgcauuacgcggcccagcccggcggguauuacaacggaaccagagaggaccggaauaagcugcgccaccugauuagcgugaaccucggcaagaucccuacagucgaaaauucuauuuuucauauggcugccugguccggcagcgcuugccacgaugggagagaguggaccuauaucggaguggacggccccgauucuaacgcccugauuaaaaucaaguacggggaagcguacacagacaccuaucacuccuacgccaauaacauucuucggacgcaagagagcgcuuguaauugcaucggaggcgauuguuaucugaugaucacagacggguccgccucuggaauuagcaaaugccgcuuccucaagaucagagagggccggauuaucaaagaaauuuuuccuaccggccgcguugagcauacagaagaguguaccugcggguucgcuuccaacaagaccaucgaaugugccugcagagauaauagcuacacagccaagcggcccuuugugaaacugaacgucgagacggacaccgcugagauccgccuuaugugcacagaaaccuaucuggauacaccgagaccugacgauggaucuauuaccggccccugugaguccaaugggggaaagggcagcgggggaaucaaaggcggcuucgugcaccagcggauggcgucuaagauugggcgcugguacagcagaacgauguccaaaacaaagcggaugggaauggaacucuauguuaaauacgacggcgacccuuggaccgauucugacgcccuggcucccagcggggugauggucuccauggaggaacccggaugguacagcuuuggcuucgagaucaaggauaagaaaugcgacgugccuuguauugggaucgagauggugcaugauggcggaaagaaaaccuggcacucugccgccacagcuaucuauugccugaugggcuccgggcagcuccugugggacaccgucacaggaguugauauggcccuuuga

SEQ ID NO: 211740 - RNA, 1401 nt, Artificial Sequence; identical to SEQ ID NO: 211627
  derived and/or modified sequence opt5 from neuraminidase__InfluenzaB__ABN59449

SEQ ID NO: 211741 - RNA, 1398 nt, Artificial Sequence; identical to SEQ ID NO: 211705
  derived and/or modified sequence opt5 from neuraminidase__InfluenzaB__ABR15999

SEQ ID NO: 211742 - RNA, 1401 nt, Artificial Sequence; identical to SEQ ID NO: 211734
  derived and/or modified sequence opt5 from neuraminidase__InfluenzaB__ABR16010

SEQ ID NO: 211743 - RNA, 1401 nt, Artificial Sequence
  derived and/or modified sequence opt5 from neuraminidase__InfluenzaB__ABR16021
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagaaaggggcggaucauuaaggagaucuucccgaccggacgcgucaaacacaccgaggaauguacaugcggcuuugccagcaauaagacgauugagugugcuugcagagacaacuccuacaccgccaaacggccuuucgugaaacuuaauguugaaacagauaccgccgagauccgccugaugugcacagacaccuaucucgauacgcccagaccugacgaugggagcauuacaggacccugugaaucuaacggcgacaagggguccggaggcaucaagggcggguuugugcaucaacggauggcuagcaaaaucggacgcugguacucuagaaccaugagcaagaccgagcggaugggcauggggcuguaugucaaguacgacggagaucccugggcggacuccgaugcccuggcuuucucuggcgugauggugagcaugaaagagccugggugguacuccuuuggcuucgaaauuaaggacaaaaagugcgaugucccguguaucggaauugagaugguucacgacggcgggaaagaaacauggcauagcgccgccaccgcuaucuauugccucaugggaucuggccagcugcuuugggauacagugacggggguggacauggcccuguga

SEQ ID NO: 211744 - RNA, 1401 nt, Artificial Sequence; identical to SEQ ID NO: 211659
  derived and/or modified sequence opt5 from neuraminidase__InfluenzaB__ACA64903

SEQ ID NO: 211745 - RNA, 1401 nt, Artificial Sequence
  derived and/or modified sequence opt5 from neuraminidase__InfluenzaB__ACA64914
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgccaagaacauucugcggacacaagaaagcgcuuguaauugcaucggcggggauuguuaucucaugauuaccgacggacccgccuccggcaucucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaaaaccaagcggaugggaaugggccuguaugucaaguacgacggggaucccuggaccgacuccgaggcccuggcucucucuggagugauggugagcauggaugaaccuggcugguacuccuucggguuugagaucaaagacaagaaaugcgaugucccguguauuggcaucgaaaugguucacgacggaggcaagacaaccuggcauagcgccgccacagcuauuuauugccugauggggucuggacagcuucugugggauacggugaccggcguggacauggcccucuga

SEQ ID NO: 211746 - RNA, 1401 nt, Artificial Sequence; identical to SEQ ID NO: 211659
  derived and/or modified sequence opt5 from neuraminidase__InfluenzaB__ACA64936

SEQ ID NO: 211747 - RNA, 1401 nt, Artificial Sequence
  derived and/or modified sequence opt5 from neuraminidase__InfluenzaB__ACA64969
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccgccaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaagaucaaauacggcgaggcguacaccgacacguaucacucuuacgccaacaagauucugcggacacaggaguccgcuuguaauugcaucgggggaaacuguuaucucaugauuaccgauggcagcgccuccggcgugucugaaugccgcuuucugaaaaucagagaggggcggaucauuaaggagaucuucccgacaggacgcgucaagcacaccgaagaguguaccugcggcuuugcuagcaauaaaacaauugaaugugccugcagagacaacuccuacacggccaagcggccuuucgugaaacuuaauguugagaccgauacagcugaaauccgccugaugugcaccgacacauaucucgauacccccagaccugacgaugggagcauuacgggacccugugagucuaacggcgacaagggguccggaggcaucaaaggcggguuugugcaucaacggauggcgagcaagaucggacgcugguacucuagaacaaugagcaaaaccgagcggaugggcauggggcuguaugucaaguacgacggagaucccugggccgacuccgaugcucuggccuucucuggcgugauggugagcaugaaggaaccugggugguacuccuuuggcuucgagauuaaagacaagaaaugcgaugucccguguaucggaauugaaaugguucacgacggcgggaaggagaccuggcauagcgccgcuacagccaucuauugccucaugggaucuggccagcugcuuugggauaccgugacagggguggacauggcgcuguga

SEQ ID NO: 211748 - RNA, 1401 nt, Artificial Sequence
  derived and/or modified sequence opt5 from neuraminidase__InfluenzaB__ACA64980
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgagcaagauucugcggacccaggaguccgccuguaacugcaucgggggaaauuguuaucucaugauuacagauggcucugcuagcggcguguccgaaugccgcuuucugaaaaucagagaggggcggaucauuaaggagaucuuccccaccggacgcgucaagcacaccgaagaguguacaugcggcuuugccagcaacaaaacgauugaaugugcuugcagagacaauucuuacaccgccaagcggccguucgugaaacuuaacguugagacagauaccgccgaaauccgccugaugugcacagacaccuaucucgauacgccuagacccgacgauggguccauuacaggaccuugugagagcaauggcgacaaggggucuggaggcaucaaaggcggguuugugcaucaacggauggcuagcaagaucggacgcugguacuccagaaccaugucuaaaaccgagcggaugggcauggggcuguaugucaaguacgacggagaucccugggcggacagcgaugcccuggcuuucuccggcgugauggugagcaugaaggaacccgggugguacucuuuuggcuucgagauuaaagacaagaaaugcgaugucccuuguaucggaauugaaaugguucacgacggcgggaaggagacauggcauuccgccgccaccgcuaucuauugccucaugggaagcggccagcugcuuugggauacagugacggggguggacauggcccuguga

SEQ ID NO: 211749 - RNA, 1401 nt, Artificial Sequence
  derived and/or modified sequence opt5 from neuraminidase__InfluenzaB__ACA64991
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaccagcggauggcuagcaaaaucggacgcugguacucuagaaccaugagcaagaccgagcggaugggcauggggcuguaugucaaauacgacggagaucccugggcggacuccgaugcccuggcuuucggcggggugauggugucuaugaaggaaccuggcugguacagcuuuggauucgagauuaaggacaaaaagugcgaugucccguguaucggcauugaaaugguucaugacgggggaaaagagacauggcacuccgccgccaccgcuaucuauugccucaugggcagcgggcaacugcuuugggauacagugacgggaguggacauggcccuguga

SEQ ID NO: 211750 - RNA, 1401 nt, Artificial Sequence; identical to SEQ ID NO: 211659
  derived and/or modified sequence opt5 from neuraminidase__InfluenzaB__ACA65013

SEQ ID NO: 211751 - RNA, 1401 nt, Artificial Sequence; identical to SEQ ID NO: 211659
  derived and/or modified sequence opt5 from neuraminidase__InfluenzaB__ACA65024

SEQ ID NO: 211752 - RNA, 1401 nt, Artificial Sequence
  derived and/or modified sequence opt5 from neuraminidase__InfluenzaB__ACA65035
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcguccaagauucugcggacccaggagagcgccuguaacugcaucgggggaaauuguuaucucaugauuacagauggcuccgcuucuggcgugagcgaaugccgcuuucugaaaaucagagaggggcggaucauuaaggagaucuucccgaccggacgcgucaagcacaccgaagaguguacaugcggcuuugccuccaacaaaacgauugaaugugcuugcagagacaauagcuacaccgccaagcggccuuucgugaaacuuaacguugagacagauaccgccgaaauccgccugaugugcacagacaccuaucucgauacgcccagaccugacgaugggucuauuacaggacccugugaguccaauggcgacaaggggagcggaggcaucaaaggcggguuugugcaucaacggauggcuucuaagaucggacgcugguacagcagaaccauguccaaaaccgagcggaugggcauggggcuguaugucaaguacgacggagaucccugggcggacucugaugcccuggcuuucagcggcgugaugguguccaugaaggaaccugggugguacagcuuuggcuucgagauuaaagacaagaaaugcgaugucccguguaucggaauugaaaugguucacgacggcgggaaggagacauggcauucugccgccaccgcuaucuauugccucaugggauccggccagcugcuuugggauacagugacggggguggacauggcccuguga

SEQ ID NO: 211753 - RNA, 1401 nt, Artificial Sequence; identical to SEQ ID NO: 211659
  derived and/or modified sequence opt5 from neuraminidase__InfluenzaB__ACA65046

SEQ ID NO: 211754 - RNA, 1401 nt, Artificial Sequence
  derived and/or modified sequence opt5 from neuraminidase__InfluenzaB__ACA65057
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugaggccgauacagcugaaauccgccugaugugcaccgacacauaucucgauacccccagaccugacgaugggagcauuacgggacccugugaguuuaacggcgacaaggggucuggaggcaucaaaggcggguucgugcaucaacggauggcguccaagaucggacgcugguacagcagaacaaugucuaaaaccgagcggaugggcauggggcuguaugucaaguacgacggagaucccugggccgacagcgaugcucuggccuuuuccggcgugauggugucuaugaaggaaccugggugguacagcuucggcuucgagauuaaagacaagaaaugcgaugucccguguaucggaauugaaaugguucacgacggcgggaaggagaccuggcauuccgccgcuacagccaucuauugccucaugggaagcggccagcugcuuugggauaccgugacagggguggacauggcgcuguga

SEQ ID NO: 211755 - RNA, 1401 nt, Artificial Sequence; identical to SEQ ID NO: 211659
  derived and/or modified sequence opt5 from neuraminidase__InfluenzaB__ACA65068

SEQ ID NO: 211756 - RNA, 1401 nt, Artificial Sequence; identical to SEQ ID NO: 211659
  derived and/or modified sequence opt5 from neuraminidase__InfluenzaB__ACA65079

SEQ ID NO: 211757 - RNA, 1401 nt, Artificial Sequence; identical to SEQ ID NO: 211659
  derived and/or modified sequence opt5 from neuraminidase__InfluenzaB__ACA65090

SEQ ID NO: 211758 - RNA, 1401 nt, Artificial Sequence; identical to SEQ ID NO: 211659
  derived and/or modified sequence opt5 from neuraminidase__InfluenzaB__ACA65101

SEQ ID NO: 211759 - RNA, 1401 nt, Artificial Sequence
  derived and/or modified sequence opt5 from neuraminidase__InfluenzaB__ACA96567
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgagugggccuauccucggcucuccugucccggcagcaccuuccaaaaggcucugcuuauuucuccucaucgcuuuggggaaacgaaaggaaauuccgccccgcugaucauuagagagcccuucaucgcuugcggcccuaacgaauguaagcacuuugcccucacccauuacgcggcccagcccgggggauauuacaauggcacacggggcgaccgcaacaaacugagacaccugaucagcgucaagcucgggaagauuccuaccguggaaaauucuaucuuccauauggcugccugguccggaagcgcuugccacgauggcaaagaguggacauauauugggguugacggacccgauaacaaugcccugcuuaagaucaaauacggcgaggcguacaccgacacguaucacucuuacgccaacaauauucugcggacacaggaguccgcuuguaacugcaucgggggaaauuguuaucucaugauuaccgauggcagcgccuccggcgugucugaaugccgcuuucugaagaucagagaggggcggaucauuaaagagaucuucccgacaggacgcgucaagcauaccgaagaguguaccugcggcuuugcuagcaacaagacaauugaaugugccugcagagacaauuccuacacggccaaacggccuuucgugaaacuuaacguugagaccgauacagcugaaauccgccugaugugcaccgacacauaucucgauacccccagaccugacgaugggagcauuacgggacccugugagucuaacggcgacaagggguccggaggcaucaagggcggguuugugcaccagcggauggcgagcaaaaucggacgcugguacucuagaacaaugagcaagaccgagcggaugggcauggggcuguaugucaaauacgacggagaucccugggccgacuccgaugcucuggccuucucuggcauuauggugagcaugaaggaaccugggugguacuccuuuggcuucgagaucaaggacaaaaagugcgaugugccguguauuggaaucgaaaugguccaugacggcgggaaagagaccuggcacagcgccgcuacagccauuuauugccucaugggaucuggccaacugcuuugggauaccguuacagggguggacauggcgcuguga

SEQ ID NO: 211760 - RNA, 1401 nt, Artificial Sequence; identical to SEQ ID NO: 211659
  derived and/or modified sequence opt5 from neuraminidase__InfluenzaB__ACA96578

SEQ ID NO: 211761 - RNA, 1401 nt, Artificial Sequence; identical to SEQ ID NO: 211747
  derived and/or modified sequence opt5 from neuraminidase__InfluenzaB__ACA96589

SEQ ID NO: 211762 - RNA, 1401 nt, Artificial Sequence; identical to SEQ ID NO: 211659
  derived and/or modified sequence opt5 from neuraminidase__InfluenzaB__ACA96600

SEQ ID NO: 211763 - RNA, 1401 nt, Artificial Sequence
  derived and/or modified sequence opt5 from neuraminidase__InfluenzaB__ACA96611
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauuaugccaacgcgucuaauguucacgcugugaaccauagcgccaccaaaggagugacacugcuucugccugaacccgaguggaccuacccuagacucuccugccccggcagcacguuccaaaaggcccugcuuauuucuccucaccgguuuggggaaaccaaaggaaauuccgcuccgcugaucauucgcgagcccuucaucgccuguggcccuaacgaaugcaagcauuuugcucucacacacuaugccgcgcagcccgggggauacuauaauggcaccagaggcgaccggaacaaacugcgccaucugaucagcgucaagcucgggaagauuccuacaguggaaaauucuaucuuccacauggccgcuugguccggaagcgccugucacgauggcaaagaguggaccuacauugggguugacggacccgauaacaaugcucugcuuaagaucaaauacggcgaggccuauacggacacauaccauucuuaugcgaacaauauucugagaacccaggaguccgccugcaacuguaucgggggaaauugcuaccucaugauuacagauggcagcgcuuccggcgugucugaaugucgguuucugaagauccgcgaggggagaaucauuaaagagaucuucccgaccggacgggucaagcacaccgaagagugcacauguggcuuugccagcaacaagacgauugaaugcgcuugucgcgacaauuccuauaccgccaaaagaccuuucgugaaacuuaacguugagacagauaccgccgaaauccggcugaugugcacagacaccuaccucgauacgccccgcccugacgaugggagcauuacaggacccugcgagucuaacggcgacaagggguccggaggcaucaagggcggguuugugcaucagagaauggcuagcaaaaucggacggugguauucucgcaccaugagcaagaccgagagaaugggcauggggcuguacgucaaauacgacggagaucccugggcggacuccgaugcccuggcuuucucuggcgugauggugagcaugaaggaaccugggugguauuccuuuggcuucgagauuaaggacaaaaagugugaugucccgugcaucggaauugaaaugguucacgacggcgggaaagagacauggcacagcgccgccaccgcuaucuacugucucaugggaucuggccggcugcuuugggauacagugacggggguggacauggcccuguga

SEQ ID NO: 211764 - RNA, 1401 nt, Artificial Sequence
  derived and/or modified sequence opt5 from neuraminidase__InfluenzaB__ACA96622
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuaucggacccugugagucuaacggcgacaagggguccggaggcaucaagggcggguuugugcaccagcggauggcuagcaaaauuggacgcugguacucuagaacaaugagcaagaccgagcggaugggcauggggcuguaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucaugacggcgggaaagagaccuggcacagcgccgccacagcuauuuauugccucaugggaucuggccaacugcuuugggauaccgugacagggguggacauggcccuguga

SEQ ID NO: 211765 - RNA, 1401 nt, Artificial Sequence; identical to SEQ ID NO: 211747
  derived and/or modified sequence opt5 from neuraminidase__InfluenzaB__ACA96633

SEQ ID NO: 211766 - RNA, 1401 nt, Artificial Sequence
  derived and/or modified sequence opt5 from neuraminidase__InfluenzaB__ACA96644
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcauuaagcucgggaagaucccuacagucgaaaauucuauuuuccacauggccgcuugguccggaagcgccugccaugauggcaaagaguggaccuauaucgggguggacggacccgauaacaaugcucugcuuaagauuaaauacggcgaggccuacacggacacauaucacucuuacgcgaacaagauccugcggacccaggaguccgccuguaauugcauugggggaaacuguuaucucaugaucacagauggcagcgcuuccggcguuucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagacaccuaucucgauacgcccagaccugacgaugggagcaucacaggacccugugagucuaacggcgacaagggguccggaggcaucaaaggcggguuuguucaucaacggauggcuagcaagauuggacgcugguacucuagaaccaugagcaaaaccgagcggaugggcauggggcuguaugugaaguacgacggagaucccugggcggacuccgaugcccuggcuuucucuggcgucaugaucagcaugaaggaaccugggugguacuccuuuggcuucgagauuaaagacaagaaaugcgaugugccguguaucggaauugaaauggugcacgacggcgggaaggagacauggcauagcgccgccaccgcuaucuauugccucaugggaucuggccagcugcuuugggauacagucacggggguugacauggcccuguga

SEQ ID NO: 211767 - RNA, 1401 nt, Artificial Sequence
  derived and/or modified sequence opt5 from neuraminidase__InfluenzaB__ACA96655
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggacgggaauggacauauaucggcguugacgggccugauucuaaugcucugcuuaagauuaaauacggagaggccuacaccgacacguaucacuccuacgcgaagaacauccugcgcacacaagaaagcgccuguaauugcauuggcggggauuguuaucucaugaucaccgacggacccgcuuccggcaucucugagugcagauuucugaaaauucgggagggccgcaucauuaaggaaaucuucccgacagggagagugaagcacaccgaggaauguaccugcggauuugccagcaacaaaacaauugagugugcuugccgggauaauuccuacacggccaagcgcccuuucgucaaacuuaacguggaaaccgacacagccgagaucagacugaugugcaccgagacauaucucgauacgccccggccuaaugacggcagcaucaccgggcccugugaaucuaacggagauaagggcuccgggggaauuaaaggcggcuuuguucaucagcgcauggcuagcaagaucgggagaugguacucucggacaaugagcaaaaccaagagaaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccacgacggaggcaagacaaccuggcauagcgcugccacagccaucuauugccugauggggucuggacagcuucugugggauacgguuaccggcguggacauggcucucuga

SEQ ID NO: 211768 - RNA, 1401 nt, Artificial Sequence
  derived and/or modified sequence opt5 from neuraminidase__InfluenzaB__ACA96666
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccgggaggaccgcaacaaacugagacaucugaucagcgucaagcucggcaagauuccuacaguggaaaauucuaucuuccacauggccgcuugguccgggagcgccugccaugauggaaaagaguggaccuauauuggcguugacgggcccgauaacaaugcucugcuuaagaucaaauacggagaggccuacacggacacauaucacucuuacgcgaacaagauucugcggacccaggaauccgccuguaauugcaucggcgggaacuguuaucucaugauuacagauggaagcgcuuccggcgugucugagugccgcuuucugaaaaucagagagggccggaucauuaaggaaaucuucccgaccgggcgcgucaagcacaccgaggaauguacaugcggauuugccagcaauaaaacgauugagugugcuugcagagacaacuccuacaccgccaagcggccuuucgugaaacuuaauguugaaacagauaccgccgagauccgccugaugugcacagacaccuaucucgauacgcccagaccugacgauggcagcauuacagggcccugugagucuaacggagaccggggcuccgggggaaucaagggcggcuuugugcaucaacgcauggcuagcaaaaucgggagaugguacucucggaccaugagcaagaccgaaagaaugggaaugggccuguaugucaaauacgacggggaucccugggcggacuccgaugcccuggcuuucucuggagugauggugagcaugaaggagccuggcugguacuccuuuggguucgaaauuaaggacaaaaagugcgaugucccguguaucggcauugagaugguucacgacgauggaaaagaaacauggcauagcgccgccaccgcuaucuauugccucaugggcucugggcagcugcuuugggacacagugacgggaguggauauggcccuguga

SEQ ID NO: 211769 - RNA, 1401 nt, Artificial Sequence
  derived and/or modified sequence opt5 from neuraminidase__InfluenzaB__ACD56581
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaaggaauguaaacauuuugcucucacccacuacgccgcgcagccugggggauauuacaacggcacacgggaggaccgcaauaagcugagacaucugaucagcgucaagcucggcaaaauucccaccguggagaacucuaucuuccacauggccgcuugguccgggagcgccugccaugauggaaaggaauggacguauauuggcguugacgggccugauucuaaugcucugcuuaaaaucaaguacggagaggccuacacagacaccuaucacuccuacgcgaacaauauucugcggacacaggaaagcgccuguaacugcaucggcgggaauuguuaucucaugauuaccgauggauccgcuucuggcaucagcgagugccgcuuucugaaaaucagagagggccggauuaucaaggaaauuuuccccaccgggcgcgugaagcacacagaggaauguacgugcggauuugccuccaacaaaaccaucgagugugcuugcagagacaauagcuacacagccaagcggccguucgucaaacuuaacguggaaaccgauacagccgagauucgccugaugugcaccgagacguaucucgacacaccuagacccgaugacggcucuaucaccgggccuugugaauccaauggaaacaagggcagcgggggaaucaaaggcggcuuuguucaucaacggauggcuucuaagauugggcgcugguacagcagaaccauguccaaaacaaagcggaugggaaugggccuguaugugaaguacgauggggaccccuggaccgacucugaugcgcuggcccucagcggagucaugguguccauggaggaacccggcugguacagcuucggguuugagaucaaagacaagaaaugcgaugugccuuguauuggcaucgaaaugguccacgacggaggcaaggagacauggcauucugcugccacggccauuuauugccugaugggguccggacagcuucugugggauaccguuacaggcguggacauggcucucuga

SEQ ID NO: 211770 - RNA, 1401 nt, Artificial Sequence
  derived and/or modified sequence opt5 from neuraminidase__InfluenzaB__ACF33793
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauauucccagaccugacgaugggagcaucacgggacccugugagucuaacggcgacaagggguccggaggcaucaagggcggguuugugcaucaacggauggcuagcaaaauuggacgcugguacucuagaacaaugagcaagaccgagcggaugggcauggggcuguaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucacgacggcgggaaagagaccuggcauagcgccgccacagcuauuuauugccucaugggaucuggccagcugcuuugggauaccgugacagggguggacauggcccuguga

SEQ ID NO: 211771 - RNA, 1401 nt, Artificial Sequence
  derived and/or modified sequence opt5 from neuraminidase__InfluenzaB__ACF33795
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccgaaaagaugggcauggggcuguaugugaaguacgacggagagcccugggcggacuccgaugcccugacauucucuggcgucauggugagcauggaggaaccugggugguacuccuuuggcuucgaaaucaaagacaagaaaugcgaugugccguguauuggaaucgagaugguccacgacggcgggaaggagaccuggcauagcgcugccacagccauuuauugccucaugggaucuggccagcugcuuugggauacgguuaccggggugaacauggcucuguga

SEQ ID NO: 211772 - RNA, 1401 nt, Artificial Sequence
  derived and/or modified sequence opt5 from neuraminidase__InfluenzaB__ACF33797
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauacccugcggacacaggaguccgccuguaacugcauugggggaaauuguuaucucaugaucaccgauggcagcgcuuccggcgugucugaaugccgcuuucugaagauuagagaggggcggaucaucaaagagauuuucccgaccggacgcgucaagcacacagaagaguguacgugcggcuuugccagcaacaagaccaucgaaugugcuugcagagacaauuccuacacagccaaacggccuuucgugaaacuuaacguugagaccgauacagccgaaauucgccugaugugcaccgagacguaucucgacacacccagaccugaugacgggagcaucaccggacccugugagucuaacggcgauaagggguccggaggcauuaagggcggguuugugcaucaacggauggcuagcaaaaucggacgcugguacucuagaaccaugagcaagacagaacggaugggcauggggcuguaugucaaauacgacggagaccccugggcggauuccgacgcccuggcucucaucggcgugauggugucuauggaggaaccugggugguacagcuucggcuuugagauuaaggauaagaaaugcgacgucccguguaucggaauugaaaugguucacgauggcgggaaggagaccuggcauuccgccgccacagcuaucuauugccugaugggaagcggccagcuucugugggacacggugaccggggugaauauggcccucuga

SEQ ID NO: 211773 - RNA, 1401 nt, Artificial Sequence; identical to SEQ ID NO: 211752
  derived and/or modified sequence opt5 from neuraminidase__InfluenzaB__ACF41662

SEQ ID NO: 211774 - RNA, 1401 nt, Artificial Sequence
  derived and/or modified sequence opt5 from neuraminidase__InfluenzaB__ACF54140
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcaccaaaggcgaccggaacaagcugcgccaucugaucagcgucaagcucgggaaaauuccuacaguggaaaauucuaucuuccacauggccgcuugguccggaagcgccugccaugauggcaaggaguggaccuauauugggguugacggacccgauaacaaugcucugcuuaaaaucaaguacggcgaggccuacacggacacauaucacucuuacgcgaacaaaauucugagaacccaggaguccgccuguaauugcaucgggggaaacuguuaucucaugauuacagauggcagcgcuuccggcgugucugaaugccgguuucugaagauccgcgaggggagaaucauuaaggagaucuucccgaccggacgggucaaacacaccgaagaguguacaugcggcuuugccagcaauaagacgauugaaugugcuugccgcgacaacuccuacaccgccaaaagaccuuucgugaaacuuaauguugagacagauaccgccgaaauccggcugaugugcacagacaccuaucucgauacgccccgcccugacgaugggagcauuacaggacccugugagucuaacggcgacagaggguccggaggcaucaagggcggguuugugcaucaacggauggcuagcaagaucggacgcugguacucuagaaccaugagcaaaaccgagcggaugggcauggggcuguaugucaaguacgacggagaucccugggcggacuccgaugcccuggcuuucucuggcgugauggugagcaugaaggaaccugggugguacuccuuuggcuucgagauuaaagacaagaaaugcgaugucccguguaucggaauugaaaugguucacgacggcgggaaggagacauggcauagcgccgccaccgcuaucuauugccucaugggaucuggccagcugcuuugggauacagugacggggguggacauggcccuguga

SEQ ID NO: 211775 - RNA, 1401 nt, Artificial Sequence
  derived and/or modified sequence opt5 from neuraminidase__InfluenzaB__ACF54151
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcaaucgcaacaagcugagacaucugaucagcgucaagcucgggaaaauuccuacaguggaaaauucuaucuuccacauggccgcuugguccggaagcgccugccaugacggcaaggaguggaccuauauugggguugauggacccgacaacaaugcucugcuuaaaaucaaguacggcgaagccuacacggauacauaucacucuuacgcgaacaauauucugcggacccaggaguccgccuguaacugcaucgggggaaauuguuaucucaugauuacagacggcagcgcuuccggcgugucugaaugccgcuuucugaaaaucagagaggggcggaucauuaaggagaucuucccgaccggacgcauuaagcacaccgaagaguguacaugcggcuuugccagcaacaaaacgaucgaaugugcuugcagagauaauuccuacaccgccaagcggccuuucgucaaacuuaacguggagacagacaccgccgaaauucgccugaugugcacagagaccuaucucgauacgcccagaccugacgaugggagcaucacaggacccugugagucuaacggcgacaagggguccggaggcaucaaaggcggguuuguucaucaacggauggcuagcaagauuggacgcugguacucuagaaccaugagcaaaaccaagcggaugggcauggggcuguaugugaaguacgauggagaccccugggcggacuccgaugcccuggcuuucucuggcgucauggugagcauggaggagccugggugguacuccuuuggcuucgaaaucaaagacaagaaaugcgaugugccguguauuggaaucgagaugguccacgacggcgggaaggaaacauggcauagcgccgccaccgcuauuuauugccucaugggaucuggccagcugcuuugggauacaguuacgggggugaauauggcccuguga

SEQ ID NO: 211776 - RNA, 1401 nt, Artificial Sequence
  derived and/or modified sequence opt5 from neuraminidase__InfluenzaB__ACF54162
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggaaaggaauggacauauaucggcguugacgggccugauucuaaugcucugcuuaaaauuaaguacggagaggccuacaccgacacguaucacuccuacgcgaaaaacauccugcggacacaagaaagcgccuguaauugcauuggcggggauuguuaucucaugaucaccgacggacccgcuuccggcaucucugagugccgcuuucugaagauuagagagggccggaucauuaaggaaaucuucccgacagggcgcgugaaacacaccgaggaauguaccugcggauuugccagcaacaagacaauugagugugcuugcagagauaauaacuacacggccaaacggccuuucgucaaacuuaauguggaaaccgacacagccgagauccgccugaugugcaccgagacauaucucgauacccccagaccuaacgacggcuccaucacggggcccugugaaagcgauggagacaagggcucugggggaauuaagggcggcuuuguucaucagcggauggcuuccaaaaucgggcgcugguacagcagaacaaugucuaagaccaagcggaugggaauggagcuguaugugaaauacgacggcgaucccuggaccgacagcgaagcgcuggcccucuccggggucauggugucuauggaggaaccuggaugguacagcuucggcuuugagauuaaggauaaaaagugcgacgugccguguaucgggauugagaugguccacgauggcggaaaaacaaccuggcauuccgcugccacagccaucuauugccugaugggcagcgggcagcuucugugggacacgguuaccggaguggauauggcucucuga

SEQ ID NO: 211777 - RNA, 1401 nt, Artificial Sequence
  derived and/or modified sequence opt5 from neuraminidase__InfluenzaB__ACF54184
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaaggaauguaaacauuuugcucucacccacuacgccgcgcagccugggggauauuacaacggcacaaaggaggaccggaauaagcugcgccaucugaucagcgucaaacucggcaagauucccaccguggagaacucuaucuuccacauggccgcuugguccgggagcgccugccaugauggaaaagaauggacguauauuggcguugacgggccugauucuaaugcucugcuuaagaucaaauacggagaggccuacacagacaccuaucacuccuacgcgaacaauauucugagaacacaggaaagcgccuguaacugcaucggcgggaauuguuaucucaugauuaccgauggauccgcuucuggcaucagcgagugccgguuucugaagauccgcgagggcagaauuaucaaggaaauuuuccccaccgggcgggugaaacacacagaggaauguacgugcggauuugccuccaacaagaccaucgagugugcuugccgcgacaauagcuacacagccaaaagaccguucgucaaacuuaacguggaaaccgauacagccgagauucggcugaugugcaccgagacguaucucgacacaccucgccccgaugacggcucuaucaccgggccuugugaauccaauggaaacaagggcagcgggggaaucaagggcggcuuuguucaucaaagaauggcuucuaaaauugggcggugguacagccgcaccauguccaagacaaagagaaugggaaugggccuguaugugaaauacgauggggaccccuggaccgacucugaugcgcuggcccucagcggagucaugguguccauggaggaacccggcugguacagcuucggguuugagaucaaggacaaaaagugcgaugugccuuguauuggcaucgaaaugguccacgacggaggcaaagagacauggcauucugcugccacggccauuuauugccugaugggguccggacagcuucugugggauaccguuacaggcguggacauggcucucuga

SEQ ID NO: 211778 - RNA, 1401 nt, Artificial Sequence
  derived and/or modified sequence opt5 from neuraminidase__InfluenzaB__ACF54206
augcugcccagcaccauccagacacucacgcuguuccuuaccuccggcggggugcugcucucucuguacgucagcgccucccuuucuuaucugcucuacagcgacauucugcugaaguuuuccacaaccgagacaaccgcuccuacaaugccgcucgauugcgccaacgcgucuaauguucaagcugugaacagaagcgccaccaaaggagugacgcugcuucugcccgaaccugaguggaccuauccccggcucuccuguccuggcagcacauuccagaaggcccugcuuaucucuccccaccgcuuuggggaaaccaaaggaaauuccgcuccucugauuaucagagagccguucauugccugcggccccaaggaauguaaacauuuugcucucacacacuacgccgcgcagccugggggauauuacaacggcacccgggaggaccgcaauaagcugagacaucugaucagcgucaagcucggcaaaauccccacgguggagaacucuauuuuccacauggccgcuugguccgggagcgccugccaugauggaaaggaauggacauauaucggcguugacgggccugauucuaaugcucugcuuaaaauuaaguacggagaggccuacaccgacacauaucacuccuacgcgaacaauauccugcggacccaggaaagcgccuguaacugcauuggcgggaauuguuaucucaugaucaccgauggauccgcuucuggcauuagcgagugccgcuuucugaaaaucagagagggccggaucauuaaggaaaucuuccccacagggcgcgugaagcacacggaggaauguaccugcggauuugccuccaacaaaacaauugagugugcuugcagagacaauagcuacaccgccaagcggccguucgucaaacuuaacguggaaacagauaccgccgagauccgccugaugugcacggagacauaucucgacaccccuagacccgaugacggcucuauuaccgggccuugugaauccaauggaaacaagggcagcgggggaaucaaaggcggcuuuguucaucaacggauggcuucuaagaucgggcgcugguacagcagaacaauguccaaaaccaagcggaugggaaugggccuguaugugaaguacgauggggaccccuggacagacucugaugcgcuggcccucagcggagucaugguguccauggaggaacccggcugguacagcuucggguuugagauuaaagacaagaaaugcgaugugccuuguaucggcauugaaaugguccacgacggaggcaaggagacguggcauucugcugccaccgccaucuauugccugaugggguccggacagcuucugugggauacaguuaccggcguggacauggcucucuga

SEQ ID NO: 211779 - RNA, 1401 nt, Artificial Sequence
  derived and/or modified sequence opt5 from neuraminidase__InfluenzaB__ACF54217
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccacaaaaggagugacccugcuucugcccgaaccugaguggacauaucccagacucuccuguccuggcagcaccuuccagaaggcccugcuuaucucuccccaucgguuuggggaaacgaaaggaaauuccgcuccucugauuauccgcgagccguucaucgccugcggccccaaggaauguaaacacuuugcucucacccauuacgccgcgcagccugggggauauuacaacggcacaagagaggaccggaauaagcugcgccaccugauuagcgucaagcucggcaaaauccccaccguggagaacucuauuuuccauauggccgcuugguccgggagcgccugccacgauggaagagaauggacauauaucggcguugacgggccugauucuaaugcucugcuuaagauuaaauacggagaggccuacaccgacacguaucacuccuacgcgaagaacauccugcggacacaagaaagcgccuguaauugcauuggcggggauuguuaucucaugaucaccgacggacccgcuuccggcaucucugagugccgcuuucugaaaauuagagagggccggaucauuaaggaaaucuucccgacagggcgcgugaagcauaccgaggaauguaccugcggauuugccagcaacaaaacaauugagugugcuugcagagauaauuccuacacggccaagcggccuuucgucaaacuuaacguggaaaccgacacagccgagauccgccugaugugcaccgagacauaucucgauacccccagaccuaaugacggcagcaucacggggcccugugaaucuaacggagauaagggcuccgggggaauuaaaggcggcuuuguucaccagcggauggcuagcaagaucgggcgcugguacucuagaacaaugagcaaaaccaagcggaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccaugacggaggcaagacaaccuggcacagcgcugccacagccaucuauugccugauggggucuggacagcuucugugggauacgguuaccggcguggacauggcucucuga

SEQ ID NO: 211780 - RNA, 1401 nt, Artificial Sequence; identical to SEQ ID NO: 211671
  derived and/or modified sequence opt5 from neuraminidase__InfluenzaB__ACF54228

SEQ ID NO: 211781 - RNA, 1401 nt, Artificial Sequence; identical to SEQ ID NO: 211692
  derived and/or modified sequence opt5 from neuraminidase__InfluenzaB__ACF54239

SEQ ID NO: 211782 - RNA, 1401 nt, Artificial Sequence
  derived and/or modified sequence opt5 from neuraminidase__InfluenzaB__ACF54261
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucuggucagcgugaagcucggcaaaaucccuacaguugagaacucuauuuuccacauggccgcuugguccgggagcgccugccaugauggaaaggaauggaccuauaucggcguggacgggcccgauucuaaugcucugcuuaaaauuaaguacggagaggccuacacggacacauaucacuccuacgcgaacaauauccugcggacccaggaaagcgccuguaacugcauuggcgggaauuguuaucucaugaucacagauggauccgcuucuggcauuagcgagugccgcuuucugaaaaucagagagggccggaucauuaaggaaaucuucccgaccgggcgcgucaagcacaccgaggaauguacaugcggauuugccuccaacaaaacgauugagugugcuugcagagacaauagcuacaccgccaagcggccuuucgugaaacuuaacguugaaacagauaccgccgagauccgccugaugugcacagagaccuaucucgacacgcccagaccugaugacggcucuauuacagggcccugugaauccaauggagauaagggcagcgggggaaucaaaggcggcuuugugcaucaacggauggcuucuaagaucgggcgcugguacagcagaaccauguccaaaaccaagcggaugggaaugggccuguaugucaaguacgacggggaccccuggacagauucugacgcgcuggcccucagcggagugaugguguccauggaggaaccuggcugguacagcuucggguuugagauuaaagauaagaaaugcgacgucccguguaucggcauugaaaugguucacgauggaggcaaggagaccuggcauucugcugccacagccaucuauugccugaugggguccggacagcuucugugggacacggugaccggcguggauauggcucucuga

SEQ ID NO: 211783 - RNA, 1401 nt, Artificial Sequence
  derived and/or modified sequence opt5 from neuraminidase__InfluenzaB__ACF54272
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaaggaauguaaacauuuugcucucacccacuacgccgcgcagccugggggauauuacaacggcacacgggaggaccgcaauaagcugagacaucugaucagcgucaagcucggcaaaauucccaccguggagaacucuaucuuccacauggccgcuugguccgggagcgccugccaugauggaaaggaauggacguauauuggcguugacgggccugauucuaaugcucugcuuaaaaucaaguacggagaggccuacacagacaccuaucacuccuacgcgaacaauauucugcggacacaggaaagcgccuguaacugcaucggcgggaauuguuaucucaugauuaccgauggauccgcuucuggcaucagcgagugccgcuuucugaaaaucagagagggccggauuaucaaggaaauuuuccccaccgggcgcgugaagcacacagaggaauguacgugcggauuugccuccaacaaaaccaucgagugugcuugcagagacaauagcuacacagccaagcggccguucgucaaacuuaacguggaaaccgauacagccgagauucgccugaugugcaccgagacguaucucgacacaccuagacccgaugacggcucuaucaccgggccuugugaauccaauggagauaagggcagcgggggaaucaaaggcggcuuuguucaucaacggauggcuucuaagauugggcgcugguacagcagaaccauguccaaaacaaagcggaugggaaugggccuguaugugaaguacgacggggaccccuggaccgauucugacgcgcuggcccucagcggagucaugguguccauggaggaacccggcugguacagcuucggguuugagaucaaagauaagaaaugcgacgugccuuguauuggcaucgaaaugguccacgauggaggcaaggagacauggcauucugcugccacggccauuuauugccugaugggguccggacagcuucugugggacaccguuacaggcguggauauggcucucuga

SEQ ID NO: 211784 - RNA, 1401 nt, Artificial Sequence
  derived and/or modified sequence opt5 from neuraminidase__InfluenzaB__ACF54283
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaaggaauguaaacauuuugcucucacccacuacgccgcgcagccugggggauauuacaacggcacacgggaggaccgcaauaagcugagacaucuggucagcgugaagcucggcaaaauccccaccguugagaacucuauuuuccacauggccgcuugguccgggagcgccugccaugauggaaaggaauggacguauaucggcguggacgggccugauucuaaugcucugcuuaaaauuaaguacggagaggccuacacagacaccuaucacuccuacgcgaacaauauccugcggacacaggaaagcgccuguaacugcauuggcgggaauuguuaucucaugaucaccgauggauccgcuucuggcauuagcgagugccgcuuucugaaaaucagagagggccggaucauuaaggaaaucuuccccaccgggcgcgucaagcacacagaggaauguacgugcggauuugccuccaacaaaaccauugagugugcuugcagagacaauagcuacacagccaagcggccguucgugaaacuuaacguugaaaccgauacagccgagauccgccugaugugcaccgagacguaucucgacacaccuagacccgaugacggcucuauuaccgggccuugugaauccaauggagauaagggcagcgggggaaucaaaggcggcuuugugcaucaacggauggcuucuaagaucgggcgcugguacagcagaaccauguccaaaacaaagcggaugggaaugggccuguaugucaaguacgacggggaccccuggaccgauucugacgcgcuggcccucagcggagugaugguguccauggaggaacccggcugguacagcuucggguuugagauuaaagauaagaaaugcgacgucccuuguaucggcauugaaaugguucacgauggaggcaaggagacauggcauucugcugccacggccaucuauugccugaugggguccggacagcuucugugggacaccgugacaggcguggauauggcucucuga

SEQ ID NO: 211785 - RNA, 1401 nt, Artificial Sequence
  derived and/or modified sequence opt5 from neuraminidase__InfluenzaB__ACF54294
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccauuccgcucgauugcgccaacgcgucuaauguucaagcugugaacagaagcgccacaaaaggagugaccuuccugcuucccgaaccugaguggacguauccccggcuguccuguccuggcagcaccuuucagaaggcccuccugaucucuccccaccgcuucggggaaacaaaaggaaauuccgcuccucuuauuaucagagagccguuuaucgccugcggccccaaggaauguaaacauuucgcucugacccacuacgccgcgcagccugggggauauuacaacggcacacgggaggaccgcaauaagcucagacaucugauuagcgucaagcugggcaaaauccccaccguggagaacucuauuuuucacauggccgcuugguccgggagcgccugccaugauggaaaggaauggacguauaucggcguugacgggccugauucuaaugcucuccugaaaauuaaguacggagaggccuacacagacaccuaucacuccuacgcgaacaauauccuucggacacaggaaagcgccuguaacugcauuggcgggaauuguuaucugaugaucaccgauggauccgcuucuggcaucagcgagugccgcuuccucaaaauuagagagggccggaucauuaaggaaaucuuucccaccgggcgcgugaagcacacagaggaauguacgugcggauucgccuccaacaaaaccauugagugugcuugcagagacaauagcuacacagccaagcggccguuugucaaacugaacguggaaaccgauacagccgagauccgccuuaugugcaccgagacguaucuggacacaccuagacccgaugacggcucuaucaccgggccuugugaauccaauggaaacaagggcagcgggggaauuaaaggcggcuucguucaucaacggauggcuucuaagaucgggcgcugguacagcagaaccauguccaaaacaaagcggaugggaaugggccucuaugugaaguacgauggggaccccuggaccgacucugaugcgcuggcccugagcggagucaugguguccauggaggaacccggcugguacagcuuuggguucgagauuaaagacaagaaaugcgaugugccuuguaucggcauugaaaugguccacgacggaggcaaggagacauggcauucugcugccacggccaucuauugccucaugggguccggacagcugcuuugggauaccguuacaggcguggacauggcucuguga

SEQ ID NO: 211786 - RNA, 1401 nt, Artificial Sequence
  derived and/or modified sequence opt5 from neuraminidase__InfluenzaB__ACF54305
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugaccuuccugcuucccgaaccugaguggacguauccccggcuguccuguccuggcagcaccuuucagaaggcccuccugauuucuccccaccgcuucggggaaacaaaaggaaauuccgcuccucuuaucauuagagagccguuuaucgccugcggccccaaggaauguaaacauuucgcucugacccacuacgccgcgcagccugggggauauuacaacggcacacgggaggaccgcaauaagcucagacaucugaucagcgucgagcugggcaagauucccaccguggaaaacucuaucuuucacauggccgcuugguccgggagcgccugccaugauggaaaagaguggacguauauuggcguugacgggccugauucuaaugcucuccugaagaucaaauacggagaagccuacacagacaccuaucacuccuacgcgaacaauauucuucggacacaggagagcgccuguaacugcaucggcgggaauuguuaucugaugauuaccgauggauccgcuucuggcaucagcgagugccgcuuccucaagaucagagaaggccggauuaucaaagagauuuuucccaccgggcgcgugaagcacacagaagaguguacgugcggauucgccuccaacaagaccaucgaaugugcuugcagagacaauagcuacacagccaaacggccguuugucaagcugaacguggagaccgauacagccgagauucgccuuaugugcaccgaaacguaucuggacacaccuagacccgaugacggcucuaucaccgggccuugugaguccaauggaaacaaaggcagcgggggaaucaagggcggcuucguucaucaacggauggcuucuaaaauugggcgcugguacagcagaaccauguccaagacaaaacggaugggaaugggccucuaugugaaguacgauggggaccccuggaccgacucugaugcgcuggcccugagcggagucaugguguccauggaggaacccggcugguacagcuuuggguucgaaaucaaggacaaaaagugcgaugugccuuguauuggcaucgagaugguccacgacggaggcaaagagacauggcauucugcugccacggccauuuauugccucaugggguccggacagcugcuuugggauaccguuacaggcguggacauggcucuguga

SEQ ID NO: 211787 - RNA, 1401 nt, Artificial Sequence
  derived and/or modified sequence opt5 from neuraminidase__InfluenzaB__ACF54316
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagagaccuaucucgacacgcccagaccugaugacgggagcauuacaggacccugugagucuaacggcgauaagggguccggaggcaucaagggcggguuugugcaucaacggauggcuagcaaaaucggacgcugguacucuagaaccaugagcaagaccgaacggaugggcauggggcuguaugucaaauacgacggagaccccugggcggauuccgacgcccuggcucucauuggcgugauggugucuauggaggaaccugggugguacagcuucggcuuugagaucaaggauaagaauugcgacgucccguguauuggaaucgaaaugguucacgauggcgggaaagagacauggcauuccgccgccaccgcuauuuauugccugaugggaagcggccagcuucugugggacacagugacgggggugaacauggcccucuga

SEQ ID NO: 211788 - RNA, 1404 nt, Artificial Sequence
  derived and/or modified sequence opt5 from neuraminidase__InfluenzaB__ACF54338
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugcucccugaacccgaguggaccuauccucggcuguccugucccggcagcacguuccagaaggcccuucugauuucuccucaccgcuuuggggaaaccaaaggaaauuccgcuccgcucaucauuagagagcccuucaucgccugcggcccuaaggaauguaaacauuuugcucugacacacuacgccgcgcagcccgggggauauuacaacggcacccggggcgaccgcaauaagcugagacaucucaucagcgucaagcuggggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucuccggacccaggaguccgccuguaauugcaucgggggaaacuguuaucugaugauuacagauggcagcgcuuccggcgugucugaaugccgcuuucuuaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacugaauguggagacagauaccgccgaaauucgccucaugugcacagagaccuaucuggacacgcccagaccugaugacgggagcaucacaggacccugugagucuaacggcgggaagggauccggcggcaucaaagggggauuuguucaucaacggauggcuagcaagauuggccgcugguacucuagaaccaugagcaaaaccgaacggaaggggaugggacuguaugugaaguacgauggcgaccccugggcggacuccgaugcccucgucuucucuggggugauggugagcauggaggaaccuggcugguacuccuuuggauucgagaucaaagacaagaaaugcgaugucccguguauuggcaucgaaaugguucacgacgggggaaaggagacauggcauagcgcugccaccgccauuuauugccugaugggcucugggcagcuucugugggauacagugacgggagugaacauggcucucuga

SEQ ID NO: 211789 - RNA, 1401 nt, Artificial Sequence
  derived and/or modified sequence opt5 from neuraminidase__InfluenzaB__ACF54349
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucaauccccaccgcuuuggggaaaccaaaggaaacucugccccucugauuaucagagagccguucaucgcuugcggccccacggaauguaagcauuuugcccucacccacuacgcggcccagccugggggauauuacaauggcacacgggaggaccgcaacaaacugagacaucugauuuccgucaagcucggcaagauccccaccguggagaauagcauuuuccacauggcugccuggucuggguccgcuugccaugauggaaaagaauggacauauaucggcguugacgggccugauagcaacgcccugcuuaagauuaaauacggagaggcguacaccgacacguaucacucuuacgccaagaauauccugcggacacaagaauccgcuuguaacugcauuggcggggauuguuaucucaugaucaccgacggaagcgccuccggcaucucugagugccgcuuucugaaaauuagagagggccggaucauuaaggaaaucuuccccacagggcgcgugaagcacaccgaggaauguaccugcggauuugcuagcaauaaaacaauugagugugccugcagagauaacuccuacacggccaagcggccguucgucaaacuuaauguggaaaccgacacagcugagauccgccugaugugcaccgagacauaucucgauaccccuagacccaacgacggcagcaucacggggccuugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcauggaggaacccggcugguacuccuucggguuugaaauuaaagauaagaaaugcgacgugccuuguaucggcauugagaugguccacgauggaggcaagacaaccuggcauagcgccgccacagcuaucuauugccugauggggucuggacagcuucugugggacacgguuaccggcguggauauggcccucuga

SEQ ID NO: 211790 - RNA, 1401 nt, Artificial Sequence
  derived and/or modified sequence opt5 from neuraminidase__InfluenzaB__ACF54371
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcauggaggaaccuggcugguacuccuucggguuugaaauuaaagauaagaaaugcgacgugccguguaucggcauugagaugguccacgauggaggcaagacaaccuggcauagcgccgccacagcuaucuauugccugacggggucuggacagcuucugugggacaccguuacaggcguggauauggcccucuga

SEQ ID NO: 211791 - RNA, 1401 nt, Artificial Sequence
  derived and/or modified sequence opt5 from neuraminidase__InfluenzaB__ACI22549
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuagaacaaugccgcucgauugcgccaacgcgucuaauguucaagcugugaaccggagcgccaccaaaggagugacacugcuucugcccgaaccugaguggaccuauccccgccucuccuguccuggcagcacguuccagaaggcccugcuuauuucuccccacagauuuggggaaaccaaaggaaauuccgcuccucugaucauucgggagccguucaucgccugcggccccaacgaauguaagcauuuugcucucacacacuacgccgcgcagccugggggauauuacaauggcacccgcggcgacagaaacaaacugcggcaucugaucagcgucaagcucgggaagauucccacaguggaggauucuaucuuccacauggccgcuugguccggaagcgccugccaugacggcaaagaguggaccuauauugggguugauggaccugacaauaacgcucugcuuaagaucaaauacggcgaagccuacacggauacauaucacucuuacgcgaauaacauucugcgcacccaggaguccgccuguaauugcaucgggggaaacuguuaucucaugauuacagacggcagcgcuuccggcgugucugaaugcagauuucugaagauccgggaggggcgcaucauuaaagagaucuuccccaccggaagagucaagcacaccgaagaguguacaugcggcuuugccagcaauaagacgauugaaugugcuugccgggauaacuccuacaccgccaaacgcccguucgugaaacuuaauguugagacagacaccgccgaaaucagacugaugugcacagagaccuaucucgauacgccucggcccgacgaugggagcauuacaggaccuugugagucuaacggcgacaagggguccggaggcaucaagggcggguuugugcaucaacgcauggcuagcaaaaucggaagaugguacucucggaccaugagcaagaccgaaagaaugggcauggggcuguaugucaaauacgacggagaucccugggcggacuccgaugcccuggcucucauuggcgugauggugucuauggaggaacccgggugguacagcuucggcuuugagaucaaggacaagaacugcgaugucccuuguauuggaaucgaaaugguucacgacggcgggaaagagacauggcauuccgccgccaccgcuauuuauugccugaugggaagcggccagcuucugugggauacagugacgggggugaauauggcccucuga

SEQ ID NO: 211792 - RNA, 1401 nt, Artificial Sequence
  derived and/or modified sequence opt5 from neuraminidase__InfluenzaB__ACI22551
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcucucacaaugccgcuggauugcgccaacgcgucuaauguucaagcugugaacagaagcgccaccaaaggagugacacuucugcuccccgaaccugaguggaccuauccccggcuguccuguccuggcagcacguuccagaaggcccuucugauuucuccccaccgcuuuggggaaaccaaaggaaauuccgcuccucucaucauuagagagccguucaucgccugcggccccaacgaauguaagcauuuugcucugacacacuacgccgcgcagccugggggauauuacaauggcacccggggcgaccgcaacaaacugagacaucucaucagcgucaagcuggggaagauucccacaguggaaaauucuaucuuccacauggccgcuugguccggaagcgccugccaugauggcaaagaguggaccuauauugggguugacggaccugauaacaaugcccuucugaagaucaaauacggcgaggcuuacacggacacauaucacucuuacgcgaacaauauucuccggacccaggaguccgccuguaacugcaucgggggaaauuguuaucugaugauuacagauggcagcgcuuccggcgugucugaaugccgcuuucuuaagaucagagaggggcggaucauuaaagagaucuuccccaccggacgcgucaagcacaccgaagaguguacaugcggcuuugccagcaacaagacgauugaaugugcuugcagagacaauuccuacaccgccaaacggccguucgugaagcugaacguugagacagauaccgccgaaauccgccucaugugcacagagaccuaucuggacacgccuagacccgaugacgggagcauuacaggaccuugugagucuaacggcgauaaaggguccggaggcaucaagggcggguuugugcaucaacggauggcuagcaaaaucggacgcugguacucuagaaccaugagcaagaccgaacggaugggcauggggcuguaugucaaauacgacggagaccccugggcggauuccgacgcccucgcucugauuggcgugauggugucuauggaggaacccgggugguacagcuucggcuuugagaucaaggauaagaauugcgacgucccuuguauuggaaucgaaaugguucacgauggcgggaaagagacauggcauuccgccgccaccgcuauuuauugccuuaugggaagcggccagcugcucugggacacagugacgggggugaacauggcccuguga

SEQ ID NO: 211793 - RNA, 1401 nt, Artificial Sequence; identical to SEQ ID NO: 211792
  derived and/or modified sequence opt5 from neuraminidase__InfluenzaB__ACI22555

SEQ ID NO: 211794 - RNA, 1401 nt, Artificial Sequence; identical to SEQ ID NO: 211659
  derived and/or modified sequence opt5 from neuraminidase__InfluenzaB__ACI22557

SEQ ID NO: 211795 - RNA, 1401 nt, Artificial Sequence
  derived and/or modified sequence opt5 from neuraminidase__InfluenzaB__ACI22559
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaaccugagcgccaccaaaggagugacacuucugcucccugaacccgaguggaccuauccuagacuguccugucccggcagcacguuccagaaggcccuucugauuucuccucaccgguuuggggaaaccaaaggaaauuccgcuccgcucaucauucgcgagcccuucaucgccugcggcccuaaggaauguaaacauuuugcucugacacacuacgccgcgcagcccgggggauauuacaacggcaccagaggcgaccggaauaagcugcgccaucucaucagcgucaagcuggggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucucagaacccaggaguccgccuguaauugcaucgggggaaacuguuaucugaugauuacagauggcagcgcuuccggcgugucugaaugccgguuucuuaaaauccgcgaggggagaaucauuaaggagaucuucccgaccggacggauuaagcacaccgaagaguguacaugcggcuuugccagcaauaaaacgaucgaaugugcuugccgcgacaacuccuacaccgccaagagaccuuucgucaaacugaauguggagacagauaccgccgaaauucggcucaugugcacagagaccuaucuggacacgccccgcccugaugacgggagcaucacaggacccugugagucuaacggcgggaagggauccggcggcaucaaagggggauuuguucaucaaagaauggcuagcaagauuggccggugguacucucgcaccaugagcaaaaccgaaagaaaggggaugggacuguaugugaaguacgauggcgaccccugggcggacuccgaugcccucgcuuucucuggggucauggugagcauggaggaaccuggcugguacuccuuuggauucgagaucaaagacaagaaaugcgaugugccguguauuggcaucgaaaugguccacgacgggggaaaggagacauggcauagcgccgccaccgcuauuuauugccugaugggcucugggcagcuucugugggauacaguuacgggagugaacauggcccucuga

SEQ ID NO: 211796 - RNA, 1401 nt, Artificial Sequence
  derived and/or modified sequence opt5 from neuraminidase__InfluenzaB__ACI22561
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggaggcacacugcuucugccugaacccgaguggaccuauccucggcucuccugucccgggagcacguuccagaaggcccugcuuauuucuccucaccgcuuuggagaaaccaaaggcaauuccgcuccgcugaucauuagagagcccuucaucgccugcgggccuaacgaauguaagcauuuugcucucacacacuacgccgcgcagcccggaggcuauuacaauggcacccgcggggaccggaacaaacugagacaucugaucagcgugaagcucggaaagauuccuacagucgaaaauucuaucuuccacauggccgcuugguccggcagcgccugccaugaugggaaagaguggaccuauauuggaguggacggccccgauaacaaugcucugcuuaagaucaaauacggggaggccuacacggacacauaucacucuuacgcgaacaagauucugcggacccaggaguccgccuguaauugcaucggaggcaacuguuaucucaugauuacagauggcagcgcuuccgggguuucugaaugccgcuuucugaaaaucagagagggacggaucauuaaggagaucuucccgaccggccgcgugaagcacaccgaagaguguacaugcggguuugccagcaauaaaacgauugaaugugcuugcagagacaacuccuacaccgccaagcggccuuucgucaaacuuaauguggagacagauaccgccgaaauccgccugaugugcacagacaccuaucucgauacgcccagaccugacgauggaagcauuacaggccccugugagucuaacggggacaagggauccggcggcaucaaagggggauuuguucaucaacggauggcuagcaagaucggccgcugguacucuagaaccaugagcaaaaccgagcggauggggaugggacuguaugugaaguacgacggcgaucccugggcggacuccgaugcccuggcuuucucuggggucauggugagcaugaaggaaccuggcugguacuccuuuggauucgagauuaaagacaagaaaugcgaugugccguguaucggcauugaaaugguccacgacgggggaaaggagacauggcauagcgccgccaccgcuaucuauugccucaugggcucugggcagcugcuuugggauacaguuacgggaguggacauggcccuguga

SEQ ID NO: 211797 - RNA, 1401 nt, Artificial Sequence; identical to SEQ ID NO: 211659
  derived and/or modified sequence opt5 from neuraminidase__InfluenzaB__ACI22563

SEQ ID NO: 211798 - RNA, 1401 nt, Artificial Sequence
  derived and/or modified sequence opt5 from neuraminidase__InfluenzaB__ACI22565
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaaggaauguaaacacuuugcucucacacauuacgccgcgcagcccgggggauauuacaacggcaccagaggcgaccggaauaagcugcgccaccugaucagcgucaagcucgggaaaauuccuacaguggagaacucuaucuuccauauggccgcuugguccggaagcgccugccacgauggcaaggaguggaccuauauugggguugacggacccgauaauaacgcucugcuuaaaaucaaguacggcgaagccuacacggacacauaucacucuuacgcgaauaacauucugagaacccaggaguccgccuguaauugcaucgggggaaacuguuaucucaugauuacagauggcagcgcuuccggcgugucugaaugccgguuucugaaaauccgcgaggggagaaucauuaaggagaucuucccgaccggacggauuaagcauaccgaagaguguacaugcggcuuugccagcaauaaaacgaucgaaugugcuugccgcgacaacuccuacaccgccaagagaccuuucgucaaacuuaauguggagacagauaccgccgaaauucggcugaugugcacagagaccuaucucgacacgccccgcccugaugacgggagcaucacaggacccugugagucuaacggcgggaagggauccggcggcaucaaagggggauuuguucaccaaagaauggcuagcaagauuggccggugguacucucgcaccaugagcaaaaucgaaagaaaggggaugggacuguaugugaaguacgauggcgaccccugggcggacuccgaugcccuggcuuucucuggggucauggugagcauggaggaaccuggcugguacuccuuuggauucgagauucgggacaaaaagugcgaugugccguguaucggcauugaaaugguccaugacgggggaaaagagaccuggcacagcgccgccacagcuaucuauugccucaugggcucugggcagcugcuuugggauaccguuacaggagugaacauggcccuguga

SEQ ID NO: 211799 - RNA, 1401 nt, Artificial Sequence; identical to SEQ ID NO: 211659
  derived and/or modified sequence opt5 from neuraminidase__InfluenzaB__ACI22567

SEQ ID NO: 211800 - RNA, 1401 nt, Artificial Sequence; identical to SEQ ID NO: 211659
  derived and/or modified sequence opt5 from neuraminidase__InfluenzaB__ACI22569

SEQ ID NO: 211801 - RNA, 1401 nt, Artificial Sequence
  derived and/or modified sequence opt5 from neuraminidase__InfluenzaB__ACJ53908
augcugcacagcaccauccagacacucacgcuguuccuuaccuccggcggggugcugcucucucuguacgucagcgccucccuuucuuaucugcucuacagcgacauucugcugaaguuuucccaaacagagaucaccgcucccauuaugccucucgauugcgccaacgcgucuagcguucaggcugugaauagauccgccgccaaaggagugacacugcuucugccggaacccgaguggaccuauccucggcucagcugucccggcucuacauuccagaaggcucugcuuaucuccccucaucgcuuuggggaaaccaaaggaaacagcgcuccccugauuaucagagagccuuucaucgccugcggcccgacggaauguaagcacuuugcccucacccauuacgcggcccagcccgggggauauuacaauggcacacgggaggaccgcaacaaacugagacaccugauuucugucaagcucggcaagaucccuaccguggaaaauuccauuuuccauauggcugccuggagcgggucugcuugccacgauggaaaagaauggacauauaucggcguugacgggcccgauuccaacgcccugcuuaagauuaaauacggagaggcguacaccgacacguaucacagcuacgccaagaauauccugcggacacaagaauccgcuuguaacugcauuggcggggauuguuaucucaugaucaccgacggaccugccucuggcaucagcgagugccgcuuucugaaaauuagagagggccggaucauuaaggaaaucuuccccacagggcgcgugaagcauaccgaggaauguaccugcggauuugcuuccaauaaaacaauugagugugccugcagagauaacagcuacacggccaagcggccguucgucaaacuuaauguggaaaccgacacagcugagauccgccugaugugcaccgagacauaucucgauaccccuagacccaacgacggcucuaucacggggccuugugaauccgauggagacaagggcagcgggggaauuaaaggcggcuuuguucaccagcggauggcgucuaagaucgggcgcugguacagcagaacaauguccaaaaccaagcggaugggaaugggccuguaugugaaguacgacggggaucccuggaccgacucugaggcccuggcucucagcggagucaugguguccauggaggagcccggcugguacagcuucggguuugaaauuaaagauaagaaaugcgacgugccuuguaucggcauugagaugguccaugauggaggcaagacaaccuggcacucugccgccacagcuaucuauugccugaugggguccggacagcuucugugggacacgguuaccggcguggauauggcccucuga

SEQ ID NO: 211802 - RNA, 1401 nt, Artificial Sequence; identical to SEQ ID NO: 211677
  derived and/or modified sequence opt5 from neuraminidase__InfluenzaB__ACN32560

SEQ ID NO: 211803 - RNA, 1401 nt, Artificial Sequence; identical to SEQ ID NO: 211747
  derived and/or modified sequence opt5 from neuraminidase__InfluenzaB__ACN32582

SEQ ID NO: 211804 - RNA, 1401 nt, Artificial Sequence; identical to SEQ ID NO: 211659
  derived and/or modified sequence opt5 from neuraminidase__InfluenzaB__ACN32593

SEQ ID NO: 211805 - RNA, 1401 nt, Artificial Sequence
  derived and/or modified sequence opt5 from neuraminidase__InfluenzaB__ACN32604
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugaguuuaacggcgacaaggggucuggaggcaucaagggcggguucgugcaccagcggauggcuuccaaaaucggacgcugguacagcagaaccaugucuaagaccgagcggaugggcauggggcuguaugucaaauacgacggagaucccugggcggacagcgaugcccuggcuuuuuccggcgugauggugucuaugaaggaaccugggugguacagcuucggcuucgagauuaaggacaaaaagugcgaugucccguguaucggaauugaaaugguucaugacggcgggaaagagacauggcacuccgccgccaccgcuaucuauugccucaugggaagcggccaacugcuuugggauacagugacggggguggacauggcccuguga

SEQ ID NO: 211806 - RNA, 1401 nt, Artificial Sequence; identical to SEQ ID NO: 211659
  derived and/or modified sequence opt5 from neuraminidase__InfluenzaB__ACN32615

SEQ ID NO: 211807 - RNA, 1401 nt, Artificial Sequence
  derived and/or modified sequence opt5 from neuraminidase__InfluenzaB__ACN32775
augcugcccagcaccauccagacacucacgcuguuccuuaccuccggcggggugcugcucucucuguacgucagcgccucccuuucuuaucugcucuacagcgacauucugcugaaguuuuccccuacagagaucaacgcuccgaccaugccccucgauugcgccaaugcgucuaacguucacgcugugaauagaagcgccacaaaaggagugacccugcuucugccugaacccgaguggacauauccucggcucuccugucccggcagcaccuuccaaaaggcccugcuuauuucuccucaucgcuuuggggaaacgaaaggaaacuccgcuccgcugaucauuagagagcccuucaucgccugcggcccuaaugaauguaagcacuuugcucucacccauuacgccgcgcagcccgggggauauuacaacggcacacggggcgaccgcaauaaacugagacaccugaucagcgucaagcucgggaagauuccuaccguggagaacucuaucuuccauauggccgcuugguccggaagcgccugccacgauggcaaagaguggacauauauugggguugacggacccgauaauaacgcucugcuuaagaucaaauacggcgaagccuacaccgacacguaucacucuuacgcgaauaacauucugcggacacaggaguccgccuguaauugcaucgggggaaacuguuaucucaugauuaccgauggcagcgcuuccggcaucucugaaugccgcuuucugaagaucagagaggggcggauuaucaaagagauuuucccgacaggacgcgugaagcauaccgaagaguguaccugcggcuuugccagcaauaaguccaucgaaugugcuugcagagacaacagcuacacagccaaacggccuuucgucaaacuuaacguggagacggauaccgccgaaauucgccugaugugcacagacaccuaucucgauacacccagaccugacgaugggucuaucaccggacccugugaguccaauggcgacaaggggagcggaggcaucaagggcggguuuguucaccagcggauggcuucuaaaauuggacgcugguacagcagaacgauguccaagacagagcggaugggcauggggcuguaugugaaauacgacggagaucccugggcggacucugaugcccuggcuuucagcggcgucaugguguccaugaaggaaccugggugguacagcuuuggcuucgagaucaaggacaaaaagugcgaugugccguguauuggaaucgaaaugguccaugacggcgggaaagagaccuggcacucugccgccaccgcuauuuauugccucaugggauccggccaacugcuuugggauacaguuaccgggguggacauggcccuguga

SEQ ID NO: 211808 - RNA, 1401 nt, Artificial Sequence; identical to SEQ ID NO: 211659
  derived and/or modified sequence opt5 from neuraminidase__InfluenzaB__ACN32786

SEQ ID NO: 211809 - RNA, 1401 nt, Artificial Sequence
  derived and/or modified sequence opt5 from neuraminidase__InfluenzaB__ACO05928
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccuggcuuucucuggcgucauggugccuauggaggaaccggggugguacagcuuuggcuucgaaaucaaagauaagaaaugcgacgugcccuguauuggaaucgagaugguccacgauggcgggaaggaaacauggcauuccgccgccaccgcuauuuauugccucaugggaagcggccagcugcuuugggacacaguuacgggggugaacauggcccuguga

SEQ ID NO: 211810 - RNA, 1401 nt, Artificial Sequence; identical to SEQ ID NO: 211671
  derived and/or modified sequence opt5 from neuraminidase__InfluenzaB__ACO05950

SEQ ID NO: 211811 - RNA, 1401 nt, Artificial Sequence
  derived and/or modified sequence opt5 from neuraminidase__InfluenzaB__ACO05961
augcugcccagcaccauccagacacucacgcuguuccuuaccuccggcggggugcugcucucucuguacgucagcgccucccuuucuuaucugccuuacagcgacauucuccugaaguuuccguccacagagaucaccgcucccacaaugccucuggauugcgccaacgcgucuaauguucaagcugugaacagaagcgccaccaaaggagugacacuccugcuucccgaaccugaguggaccuauccccggcuguccuguccuggcagcacguuccagaaggcccuccugauuucuccgcaccgcuuuggggaaaccaaaggaaauuccgcuccccuuaucauuagagagccuuucaucgccugcggccccaaggaauguaaacauuuugcucugacacacuacgccgcgcagccugggggauauuacaacggcacccggggcgaccgcaauaagcucagacaucugaucagcgucaagcuggggaaaauucccacaguggagaacucuaucuuccacauggccgcuugguccggaagcgccugccaugauggcaaggaguggaccuauauugggguugacggaccggauaauaacgcucuccugaaaaucaaguacggcgaagccuacacggacacauaucacucuuacgcgaauaacauucuucggacccaggaguccgccuguaauugcaucgggggaaacuguuaucugaugauuacagauggcagcgcuuccggcgugucugaaugccgcuuucucaaaaucagagaggggcggaucauuaaggagaucuucccuaccggacgcauuaagcacaccgaagaguguacaugcggcuuugccagcaauaaaacgaucgaaugugcuugcagagacaacuccuacaccgccaagcggcccuucgucaaacugaauguggagacagauaccgccgaaauucgccuuaugugcacagagaccuaucuggacacgccuagacccgaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcucuaugugaaguacgacggagacccuugggcggauuccgacgcccuggcuuucucuggcgucauggugagcauggaggaaccggggugguacuccuuuggcuucgaaaucaaagauaagaaaugcgacgugcccuguauuggaaucgagaugguccacgauggcgggaaggaaacauggcauagcgccgccaccgcuauuuauugccugaugggaucuggccagcuccugugggacacaguuacgggggugaacauggcccuuuga

SEQ ID NO: 211812 - RNA, 1401 nt, Artificial Sequence
  derived and/or modified sequence opt5 from neuraminidase__InfluenzaB__ACO05972
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcauggaggaaccuggcugguacuccuucggguuugaaauuaaagauaagaaaugcgacgugccguguaucggcauugagaugguccacgauggaggcaagacaaccuggcauagcgccgccacagcuaucuauugccugauggggucuggacagcuucugugggacacgguuaccggcguggauauggcccucuga

SEQ ID NO: 211813 - RNA, 1401 nt, Artificial Sequence; identical to SEQ ID NO: 211812
  derived and/or modified sequence opt5 from neuraminidase__InfluenzaB__ACO05983

SEQ ID NO: 211814 - RNA, 1401 nt, Artificial Sequence; identical to SEQ ID NO: 211812
  derived and/or modified sequence opt5 from neuraminidase__InfluenzaB__ACO05994

SEQ ID NO: 211815 - RNA, 1401 nt, Artificial Sequence
  derived and/or modified sequence opt5 from neuraminidase__InfluenzaB__ACO06005
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgaccggggguccggaggcaucaagggcggguuugugcaucaacgcauggcuagcaaaaucggaagaugguacucucggaccaugagcaagaccgagagaaugggcauggggcuguaugucaaauacgacggagaucccugggcggacuccgaugcccuggcuuucucuggcgugauggugagcaugaaggaaccugggugguacuccuuuggcuucgagauuaaggacaaaaagugcgaugucccguguaucggaauugaaaugguucacgacggcgggaaagagacauggcauagcgccgccaccgcuaucuauugccucaugggaucuggccagcugcuuugggauacagugacggggguggacauggcccuguga

SEQ ID NO: 211816 - RNA, 1401 nt, Artificial Sequence
  derived and/or modified sequence opt5 from neuraminidase__InfluenzaB__ACO06027
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcauggaggaaccuggcugguacuccuucggguuugaaauuaaagauaagaaaugcgacgugccguguaucggcauugagaugguccacgauggaggcaagacaaccuggcauagcgccgccacagcuaucuauugccugauggggucuggacagcuucugugggacacgguuaccggcguggauaugacacucuga

SEQ ID NO: 211817 - RNA, 1401 nt, Artificial Sequence
  derived and/or modified sequence opt5 from neuraminidase__InfluenzaB__ACO06066
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcguggccaaaggagucacacugcuucugcccgaaccugaguggaccuauccccggcucuccuguccuggcagcacauuccagaaggcccugcuuaucucuccccaccgcuuuggggaaaccaaaggaaauuccgcuccucugauuaucagagagccguucaucgccugcggccccacggaauguaagcauuuugcucucacccacuacgccgcgcagccugggggauauuacaacggcacacgggaggaccgcaauaaacugagacaucugauuagcgugaagcucggcaagauccccaccguugagaacucuauuuuccacauggccgcuugguccgggagcgccugccaugauggaaaagaauggacauauaucggcguggacgggccugauucuaaugcucugcuuaagauuaaauacggagaggccuacaccgacacguaucacuccuacgcgaagaacauccugcggacacaagaaagcgccuguaauugcauuggcggggauuguuaucucaugaucaccgacggacccgcuuccggcaucucugagugccgcuuucugaaaauuagagagggccggaucauuaaggaaaucuucccgacagggcgcgucaagcacaccgaggaauguaccugcggauuugccagcaacaaaacaauugagugugcuugcagagauaauuccuacacggccaagcggccuuucgugaaacuuaacguugaaaccgacacagccgagauccgccugaugugcaccgagacauaucucgauacccccagaccuaaugacggcagcaucacggggcccugugaaucugauggagacaagggcuccgggggaauuaaaggcggcuuugugcaucagcggauggcuagcaagaucgggcgcugguacucuagaacaaugagcaaaaccaagcggaugggaaugggccuguaugucaaguacgacggggaucccuggaccgacuccgaggcgcuggcccucucuggagugauggugagcauggaggaaccuggcugguacuccuucggguuugaaauuaaagauaagaaaugcgacgucccguguaucggcauugagaugguucacgauggaggcaagacaaccuggcauagcgcugccacagccaucuauugccugauggggucuggacagcuucugugggacacggugaccggcguggauaugacacucuga

SEQ ID NO: 211818 - RNA, 1401 nt, Artificial Sequence
  derived and/or modified sequence opt5 from neuraminidase__InfluenzaB__ACO94665
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuucuacaaugccgcucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgaacaagauucugcggacccaggagagcgccuguaauugcaucgggggaaacuguuaucucaugauuacagauggcuccgcuucuggcgugagcgaaugccgcuuucugaaaaucagagaggggcggaucauuaaggagaucuuccccaccggacgcgucaagcacaccgaagaguguacaugcggcuuugccuccaauaaaacgauugaaugugcuugcagagacaacagcuacaccgccaagcggccguucgugaaacuuaauguugagacagauaccgccgaaauccgccugaugugcacagacaccuaucucgauacgccuagacccgacgaugggucuauuacaggaccuugugaguccaacggcgacaaggggagcggaggcaucaaaggcggguuugugcaucaacggauggcuucuaagaucggacgcugguacagcagaaccauguccaaaaccgagcggaugggcauggggcuguaugucaaguacgacggagaucccugggcggacucugaugcccuggcuuucagcggcgugaugguguccaugaaggaacccgggugguacagcuuuggcuucgagauuaaagacaagaaaugcgaugucccuuguaucggaauugaaaugguucacgacggcgggaaggagacauggcauucugccgccaccgcuaucuauugccucaugggauccggccagcugcuuugggauacagugacggggguggacauggcccuguga

SEQ ID NO: 211819 - RNA, 1401 nt, Artificial Sequence; identical to SEQ ID NO: 211659
  derived and/or modified sequence opt5 from neuraminidase__InfluenzaB__ACQ45607

SEQ ID NO: 211820 - RNA, 1401 nt, Artificial Sequence
  derived and/or modified sequence opt5 from neuraminidase__InfluenzaB__ACQ45610
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaguuccccucgauugcgccaacgcgucuaaugugcaagcugugaacagaagcgccaccaaaggagucacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgugaagcucgggaagauuccuacaguugaaaauucuaucuuccacauggccgcuugguccggaagcgccugccaugauggcaaagaguggaccuauauugggguggacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgucucugaaugccgcuuucugaaaaucagagaggggcggaucauuaaggagaucuucccgaccggacgcgugaaguacaccgaagaguguacaugcggcuuugccagcaauaaaacgauugaaugugcuugcagagacaacuccuauaccgccaagcggccuuucguuaaacuuaauguggagacagauaccgccgaaauccgccugaugugcacagacaccuaccucgauacgcccagaccugacgaugggagcauuacaggacccugugagucuaacggcgacaagggguccggaggcaucaaaggcggguuuguccaccaacggauggcuagcaagaucggacgcugguauucuagaaccaugagcaaaaccgagcggaugggcauggggcuguacgugaaguacgacggagaucccugggcggacuccgaugcccuggcuuucucuggcgugauggucagcaugaaggaaccugggugguauuccuuuggcuucgagauuaaagacaagaaaugcgauguuccguguaucggaauugaaauggugcaugacggcgggaaggagacauggcacagcgccgccaccgcuaucuacugccucaugggaucuggccagcugcuuugggauacagugacgggggucgacauggcccuguga

SEQ ID NO: 211821 - RNA, 1401 nt, Artificial Sequence; identical to SEQ ID NO: 211659
  derived and/or modified sequence opt5 from neuraminidase__InfluenzaB__ACQ45613

SEQ ID NO: 211822 - RNA, 1401 nt, Artificial Sequence; identical to SEQ ID NO: 211815
  derived and/or modified sequence opt5 from neuraminidase__InfluenzaB__ACR15626

SEQ ID NO: 211823 - RNA, 1401 nt, Artificial Sequence; identical to SEQ ID NO: 211815
  derived and/or modified sequence opt5 from neuraminidase__InfluenzaB__ACR15637

SEQ ID NO: 211824 - RNA, 1401 nt, Artificial Sequence; identical to SEQ ID NO: 211786
  derived and/or modified sequence opt5 from neuraminidase__InfluenzaB__ACR15648

SEQ ID NO: 211825 - RNA, 1401 nt, Artificial Sequence; identical to SEQ ID NO: 211815
  derived and/or modified sequence opt5 from neuraminidase__InfluenzaB__ACR15659

SEQ ID NO: 211826 - RNA, 1401 nt, Artificial Sequence; identical to SEQ ID NO: 211815
  derived and/or modified sequence opt5 from neuraminidase__InfluenzaB__ACR15670

SEQ ID NO: 211827 - RNA, 1401 nt, Artificial Sequence; identical to SEQ ID NO: 211640
  derived and/or modified sequence opt5 from neuraminidase__InfluenzaB__ACR15681

SEQ ID NO: 211828 - RNA, 1401 nt, Artificial Sequence
  derived and/or modified sequence opt5 from neuraminidase__InfluenzaB__ACR15692
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucggaugcgccaacgcgucuaauguucaagcugugaacagaagcgccaccaaaggcgugacacugcuucugccugaacccgaguggaccuauccucggcucuccugucccgggagcacguuccagaaggcccugcuuauuucuccucaccgcuuuggagaaaccaaaggcaauuccgcuccgcugaucauuagagagcccuucaucgccugcgggccuaaggaauguaaacauuuugcucucacacacuacgccgcgcagcccggaggcuauuacaacggcacccgcggggaucggaauaagcugagacaucugaucagcgucaagcucggaaaaauuccuacaguggagaacucuaucuuccacauggccgcuugguccggcagcgccugccaugacgggaaggaguggaccuauauuggaguugauggccccgacaauaacgcucugcuuaaaaucaaguacggggaagccuacacggauacauaucacucuuacgcgaauaacauucugcggacccaggaguccgccuguaauugcaucggaggcaacuguuaucucaugauuacagacggcagcgcuuccgggaucucugaaugccgcuuucugaaaaucagagagggacggauuaucaaggagauuuucccgaccggccgcgugaagcacaccgaagaguguacaugcggguuugccagcaauaaaacgaucgaaugugcuugcagagauaacuccuacaccgccaagcggccuuucgucaaacuuaauguggagacagacaccgccgaaauucgccugaugugcacagagaccuaucucgauacgcccagaccugacgauggaagcaucacaggccccugugagucuaacggggacaagggauccggcggcaucaaagggggauuuguucaucaacggauggcuagcaagauuggccgcugguacucuagaaccaugagcaaaaccaagcggauggggaugggacuguaugugaaguacgauggcgaccccugggcggacaacgaugcccuggcucucuccggggucauggugucuauggaggaaccuggcugguacagcuucggauuugaaaucaaagacaagaaaugcgaugugccguguauuggcaucgagaugguccacgacgggggaaaggaaacauggcauuccgccgccaccgcuauuuauugccugaugggcagcgggcagcuucugugggauacaguuacgggaguggacauggcccucuga

SEQ ID NO: 211829 - RNA, 1401 nt, Artificial Sequence; identical to SEQ ID NO: 211816
  derived and/or modified sequence opt5 from neuraminidase__InfluenzaB__ACR15703

SEQ ID NO: 211830 - RNA, 1401 nt, Artificial Sequence; identical to SEQ ID NO: 211816
  derived and/or modified sequence opt5 from neuraminidase__InfluenzaB__ACR15714

SEQ ID NO: 211831 - RNA, 1401 nt, Artificial Sequence; identical to SEQ ID NO: 211731
  derived and/or modified sequence opt5 from neuraminidase__InfluenzaB__ACR15725

SEQ ID NO: 211832 - RNA, 1401 nt, Artificial Sequence; identical to SEQ ID NO: 211692
  derived and/or modified sequence opt5 from neuraminidase__InfluenzaB__ACR15736

SEQ ID NO: 211833 - RNA, 1401 nt, Artificial Sequence; identical to SEQ ID NO: 211815
  derived and/or modified sequence opt5 from neuraminidase__InfluenzaB__ACR39340

SEQ ID NO: 211834 - RNA, 1401 nt, Artificial Sequence
  derived and/or modified sequence opt5 from neuraminidase__InfluenzaB__ADL28399
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagauuaucgaaugugcuugcagagacuccagcuacacggccaaacggccuuucgugaaacuuaauguugagaccgauacagccgaaauucgccugaugugcaccgagacauaucucgacacccccagaccuaacgaugggucuaucacgggacccugugaguccaacggcgacaaggggagcggaggcaucaagggcggguuugugcaucaacggauggcuucuaaaauuggacgcugguacagcagaacaauguccaagaccgaacggaugggcauggggcuguaugucaaauacgauggagaccccugggcggacucugaugcccuggcucucagcggcgugaugguguccauggaggaaccugggugguacagcuucggcuuugagaucaaggacaagaaaugcgaugucccguguauuggaaucgaaaugguucacgacggcgggaaggagaccuggcauucugccgccacagcuauuuauugccugaugggauccggccagcuucugugggauaccgugacagggguggacauggcccucuga

SEQ ID NO: 211835 - RNA, 1401 nt, Artificial Sequence; identical to SEQ ID NO: 211812
  derived and/or modified sequence opt5 from neuraminidase__InfluenzaB__ADN32822

SEQ ID NO: 211836 - RNA, 1401 nt, Artificial Sequence
  derived and/or modified sequence opt5 from neuraminidase__InfluenzaB__ADR02756
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaucccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuauuucuccccaccgcuuuggggaaaccaaaggaaauuccgccccucugaucaucagagagccguucauugcuugcggccccacggaauguaagcauuuugcccucacccacuacgcggcccagccugggggauauuacaacggcacacgggaggaccgcaauaaacugagacaucugaucagcgucaagcucggcaagauucccaccguggagaacucuaucuuccacauggcugccugguccgggagcgcuugccaugauggaaaagaauggacauauauuggcguugacgggccugauucuaaugcccugcuuaagaucaaauacggagaggcguacaccgacacguaucacuccuacgccaagaacauucugcggacacaagaaagcgcuuguaauugcaucggcggggauuguuaucucaugaucaccgacggacccgccuccggcauuucugagugccgcuuucugaaaaucagagagggccggauuaucaaggaaauuuucccgacagggcgcgugaagcacaccgaggaauguaccugcggauuugcuagcaacaaaacaaucgagugugccugcagagauaauuccuacacggccaagcggccuuucgucaaacuuaacguggaaaccgacacagcugagauccgccugaugugcaccgagacauaucucgauacccccagaccuaaugacggcagcauuacggggcccugugaaucugauggagacaagggcuccgggggaaucaaaggcggcuuuguucaucagcggauggcgagcaagauugggcgcugguacucuagaacaaugagcaaaaccaagcggaugggaaugggccuguaugugaaguacgacggggaucccuggaccgacuccgaggcccuggcucucucuggagucauggugagcauggaggaaccuggcugguacuccuucggguuugaaaucaaagauaagaaaugcgacgugccguguauuggcaucgagaugguccacgauggaggcaagacaaccuggcauagcgccgccacagcuaucuauugccugauggggucuggacagcuucugugggacacgguuaccggcguggauauggcccucuga

SEQ ID NO: 211837 - RNA, 1401 nt, Artificial Sequence
  derived and/or modified sequence opt5 from neuraminidase__InfluenzaB__AEA51353
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggaggcgccuuuaccgacacguaccacuccuaugcgaagaacauccugagcccccaggaguccgccuguaauugcauugggggagauuguuaccucaugaucacagacggcccggcuucuggcaucagcgaaugcagauuccugaaaauucgggaggggcgcaucauuaaggagaucuuuccuaccggaagagugaagcacacagaagaguguaccugcggcuucgccuccaacaaaaccauugaaugugcuugccgggauaauagcuauacagccaagcgccccuuugucaaacuuaacguggagacggacaccgccgaaaucagacugaugugcacagagaccuaccucgauacaccucggcccaaugacgggucuaucaccggacccugugaguccaacggcgauaaggggagcggaggcauuaaaggcggguucguucaucaacgcauggcuucuaagaucggaagaugguauagccggacgauguccaaaacaaagagaaugggcauggggcuguacgugaaguaugacggagacccuuggaccgauucugaagcgcuggcccucagcggcgucaugguguccauggaggaaccggggugguacagcuuuggcuucgagauuaaagacaagaaaugcgaugugcccuguaucggaauugaaaugguccacgacggcgggaagaccacauggcauucugcugccaccgccaucuacugccugaugggauccggccagcuucugugggauacaguuacgggggugaauaugacccucuga

SEQ ID NO: 211838 - RNA, 1401 nt, Artificial Sequence
  derived and/or modified sequence opt5 from neuraminidase__InfluenzaB__AEA51355
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacaccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaacgaauguaagcauuuugcccucacccacuacgcugcccagcccgggggauauuacaauggcacacggggcgaccgcaacaaacugagacaucugaucagcgucaagcucgggaagauuccuaccguggaaaauucuaucuuccacauggcggccugguccggaagcgcuugccaugauggcaaagaguggacguauauugggguugacggacccgauaacaaugcccugcuuaagaucacauacggcgaggcuuacccggggaccuaucacucuuacgccauuaaaaacccucggacacaggaguccgcgcccaauuguuuuggaggccacagcuucccuaucauuacccaugccccucccuccggcgugugggaaccccgcuuucugaagaucagagaggggcggaucauuaacgagaucuucccgaccggacgcgucaaacccccugaagagugcacauguggcuuugcuucuaauaacacgauugaaugcgccuguagagacaauaacugcaccgcuaagcggcccuucgugaaguuucacguugagagcgauccugccgaaauccgcgccauguguacagacaccuaucucgauucccccagaccggacgaugggagcauuacaggaccuugcgacucuaacggcgauaaaggguccggaggcaucaagggcggguucgugcaucaacggauggagagcaaaaucggacgcugguacucuagaaccaugagcaagacggagcggaugggcauggggcuguaugucaaauacgacggagaccccugggcugauuccgacgcgcuugccaauucuggcgugauggugagcaugaacgaaccuggguccagcucuuucggcuuugagauuaaggauaaaaagugcgacguccccuguaucggaauugaaaugguucacgauggcgggaaggagacauggcacuccgcugccaccgccaucuauugccugaugggaagcggccagcuccugugggacaccgugacagggguggauauggcucuguga

SEQ ID NO: 211839 - RNA, 1401 nt, Artificial Sequence
  derived and/or modified sequence opt5 from neuraminidase__InfluenzaB__AEA51357
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauuuggagaggccuacaccgacacguaccacuccuaugcgaagaacauccugggcacacaggaaagcgccuguaauugcauugggggagauuguaaccucaugaucaccgacggccccgcuuccggcaucucugagagcagauuccugaaaauuggggagggacggaucauuaaggaaaucuuuccgacaggccgcgugaagcacaccgaggaaugcaccuguggguucgccuccaauaaaacaauugagugcgcuuguagagauaacagcuacacggccaagcggccuuuugucaaacuuaauguggaaaccgacacagccgagauccgccugaugugcaccgagacauaucucgauacccccagaccuaacgacggaucuaucacgggccccugcgaauccaauggggauaagggaagcggcggcauuaaagggggauucguucaucaacggauggcuucuaagaucggccgcugguacagcagaacaauguccaaaaccgagcggauggggaugggacuguaugugaaguacgacggcgaccccugggcggauucugacgcccuggcuuuuagcggggucaugguguccaugaaggaaccuggcugguauagcuucggauucgagauuaaagauaagaaaugugacgugccgugcaucggcauugaaaugguccacgaugggggaaaggagaccuggcauucugccgccacagcuaucuacugucucaugggcuccgggcagcugcuuugggacaccguuacaggagugaacauggcccuguga

SEQ ID NO: 211840 - RNA, 1401 nt, Artificial Sequence
  derived and/or modified sequence opt5 from neuraminidase__InfluenzaB__AEA51359
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucugauggagacaagggcuccgggggaauuaaaggcggcuuuguucaucaaagaauggcuagcaagaucgggcggugguacucuagaacaaugagcaaaaccaagcgcaugggaaugggccuguaugugaaguacgacggggaucccuggaccgacuccgaggcgcuggcccucucuggagucauggugagcauggaggaaccuggcugguacuccuucggguuugaaauuaaagauaagaaaugcgacgugccguguaucggcauugagaugguccacgauggaggcaagacaaccuggcauagcgcugccacagccaucuauugccugauggggucuggacagcuucugugggacacgguuaccggcguggauauggcucucuga

SEQ ID NO: 211841 - RNA, 1401 nt, Artificial Sequence
  derived and/or modified sequence opt5 from neuraminidase__InfluenzaB__AEA51365
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucuaacggagauaagggcuccgggggaauuaaaggcggcuuuguucaucaaagaauggcuagcaagaucgggcggugguacucuagaacaaugagcaaaaccaagcgcaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccacgacggaggcaagacaaccuggcauagcgcugccacagccaucuauugccugauggggucuggacagcuucugugggauacgguuaccggcgugaauaugacacucuga

SEQ ID NO: 211842 - RNA, 1401 nt, Artificial Sequence; identical to SEQ ID NO: 211841
  derived and/or modified sequence opt5 from neuraminidase__InfluenzaB__AEA51367

SEQ ID NO: 211843 - RNA, 1401 nt, Artificial Sequence; identical to SEQ ID NO: 211841
  derived and/or modified sequence opt5 from neuraminidase__InfluenzaB__AEA51371

SEQ ID NO: 211844 - RNA, 1401 nt, Artificial Sequence
  derived and/or modified sequence opt5 from neuraminidase__InfluenzaB__AEA51373
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaagccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggguccggaggcauuaaaggcggguuuguccaucaacggauggcuagcaagaucggacgcugguacucuagaaccaugagcaaaaccaagcggaugggcauggggcuguaugugaaguacgacggagaucccuggacagacuccgaggcgcuggcccucucuggcgugauggucagcauggaggagccugggugguacuccuucggcuuugaaaucaaagauaagaaaugcgacguuccguguauuggaaucgagauggugcacgauggcgggaaggaaaccuggcauagcgcugccacagccauuuauugccugaugggaucuggccagcuucugugggacacggugaccggggucaacaugacacucuga

SEQ ID NO: 211845 - RNA, 1401 nt, Artificial Sequence
  derived and/or modified sequence opt5 from neuraminidase__InfluenzaB__AEA51377
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcuggccuucucuggcgugauggucagcaugaaggagccugggugguacuccuuuggcuucgaaaucaaagacaagaaaugcgauguuccguguauuggaaucgagauggugcacgacggcgggaaggaaacauggcauagcgcugccaccgccauuuauugccucaugggaucuggccagcugcuuugggauacagugacgggggucgacauggcucuguga

SEQ ID NO: 211846 - RNA, 1401 nt, Artificial Sequence; identical to SEQ ID NO: 211845
  derived and/or modified sequence opt5 from neuraminidase__InfluenzaB__AEA51379

SEQ ID NO: 211847 - RNA, 1401 nt, Artificial Sequence
  derived and/or modified sequence opt5 from neuraminidase__InfluenzaB__AEA51381
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggagaauagcaucuuccacauggccgcuugguccggaagcgccugccaugauggcaaagaguggaccuauauugggguugacggacccgauaacaaugcucugcuuaaggugaaauacggcgaagccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggaugaagucuaaaaucggacgcugguacucuagaaccaugagcaagaccgagcggaugggcauggggcuguaugugaaguacgacggagaucccugggcugacuccgaugcgcuggccuucucuggcgugauggucagcguuaaagaaccugggugguacuccuuuggcuucgagaucaaggacaaaaagugcgaugugccguguauuggaaucgaaauggugcacgacggcgggaaagagacauggcauagcgcugccaccgccauuuauugccucaugggaucuggccagcugcuuugggauacagucacggggguggacauggcucuguga

SEQ ID NO: 211848 - RNA, 1401 nt, Artificial Sequence; identical to SEQ ID NO: 211845
  derived and/or modified sequence opt5 from neuraminidase__InfluenzaB__AEA51383

SEQ ID NO: 211849 - RNA, 1401 nt, Artificial Sequence
  derived and/or modified sequence opt5 from neuraminidase__InfluenzaB__AEG20998
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauucuccggcuggccugcgcgaacgcuucuaauguucaagccgugaaccgcagcgccacaaaaggagugacccuucugcucccggaacccgaguggacauauccuagacuguccugucccggcagcaccuuccagaaggcccuucugaucucuccucaccgguuuggggaaacgaaaggaaauuccgcuccccucauuauccgcgagccuuucaucgcuugcggcccgaaggaauguaaacauuuugcccugacccacuacgcggcccagcccgggggauauuacaacggcacaagagaggaucggaauaagcugcgccaucucauuagcgucaagcugggcaaaaucccuaccguggagaacucuauuuuccacauggcugccugguccgggagcgcuugccaugacggaagagaauggacauauaucggcguugaugggcccgacucuaaugcccuucugaagauuaaauacggaggcgcguuuaccgauacguaccacuccuaugccaagaacauccucagcccucaggaguccgcuuguaauugcauugggggagacuguuaccugaugaucacagauggccccgccucuggcaucagcgaaugccgguuccuuaaaauucgcgaggggagaaucauuaaggagaucuuuccgaccggacgggugaagcacacagaagaguguaccugcggcuucgcuuccaacaaaaccauugaaugugccugccgcgacaauagcuauacagccaagagaccuuuugucaaacugaacguggagacggauaccgcugaaauccggcucaugugcacagagaccuaccuggacacaccccgcccuaaugaugggucuaucaccggacccugugaguccaacggcgacaaggggagcggaggcauuaaaggcggguucguucaucaaagaauggcgucuaagaucggacggugguauagcagaacgauguccaaaacaaagcgcaugggcauggggcuguacgugaaguaugauggagaccccuggaccgacucugaagcccucgcucugagcggcgucaugguguccauggaggaaccugggugguacagcuuuggcuucgagauuaaagauaagaaaugcgacgugccguguaucggaauugaaaugguccacgauggcgggaagaccacauggcauucugccgccaccgcuaucuacugccuuaugggauccggccagcugcucugggacacaguuacgggggugaauaugacccuguga

SEQ ID NO: 211850 - RNA, 1401 nt, Artificial Sequence
  derived and/or modified sequence opt5 from neuraminidase__InfluenzaB__AEG20999
augcugcccagcaccauccagacacucacgcuguuccuuaccuccggcggggugcugcucucucugagcgucuccgccucucuuagcuaccugcucuauuccgacauucugcugaaguuuucuagaacagagaucaccgcuccuauuaugccgcucgauugcgccaacgcgagcaauguucaagcugugaaccgguccgccacaaaaggagugacccugcuucugcccgaaccugaguggacauacccccgccucagcuguccuggcucuaccuuccagaaggcccugcuuaucagcccccacagauuuggggaaacgaaaggaaauuccgcuccucugauuauccgggagccguucaucgccugcggccccaaggaauguaaacauuuugcucucacccacuaugccgcgcagccugggggauacuauaacggcacacgcgaggacagaaauaagcugcggcaucugauuucugucaagcucggcaaaauccccaccguggagaacuccauuuuccacauggccgcuuggagcgggucugccugccaugauggacgcgaauggacauacaucggcguugacgggccugauuccaaugcucugcuuaagauuaaauauggaggcgccuuuaccgacacguaccacagcuacgcgaagaacauccugucuccccaggaguccgccuguaauugcauugggggagauuguuaucucaugaucacagacggcccggcuagcggcaucuccgaaugcagauuccugaaaauucgggaggggcgcaucauuaaggagaucuuuccuaccggaagagugaagcacacagaagaguguaccugcggcuucgccagcaacaaaaccauugaaugugcuugccgggauaauucuuacacagccaagcgccccuuugucaaacuuaacguggagacggacaccgccgaaaucagacugaugugcacagagaccuaucucgauacaccucggcccaaugacggguccaucaccggacccugugagagcaacggcgauaaggggucuggaggcauuaaaggcggguucguucaucaacgcauggcuagcaagaucggaagaugguacucccggacgaugucuaaaacaaagagaaugggcauggggcuguaugugaaguacgacggagacccuuggaccgauagcgaagcgcuggcccucuccggcgucauggugagcauggaggaaccggggugguauucuuuuggcuucgagauuaaagacaagaaaugcgaugugcccuguaucggaauugaaaugguccacgacggcgggaagaccacauggcauuccgcugccaccgccaucuacugccugaugggaagcggccagcuucugugggauacaguuacgggggugaauaugacccucuga

SEQ ID NO: 211851 - RNA, 1401 nt, Artificial Sequence
  derived and/or modified sequence opt5 from neuraminidase__InfluenzaB__AEG21000
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcugccauucucauccuggauugcgcgaacgcuucuaauguucaagccgugaaccggagcgccacaaaaggagugacccuucugcucccugaaccggaguggacauauccccgccuguccuguccuggcagcaccuuccagaaggcccuucugauuucuccccacagauuuggggaaacgaaaggaaauuccgcuccucucaucauccgggagcccuucauugcuugcggcccuaaggaauguaaacauuuugcccugacccacuacgcggcccagcccgggggauauuacaacggcacacgcgaggacagaaauaagcugcggcaucucaucagcgucaagcugggcaaaauuccgaccguggagaacucuaucuuccacauggcugccugguccgggagcgcuugccaugauggacgcgaauggacauauauuggcguugacgggccugauucuaaugcccuucugaagaucaaauacggaggcgcguuuaccgacacguaccacuccuaugccaagaacauucucagcccccaggaguccgcuuguaauugcaucgggggagauuguuaccugaugaucacagacggcccugccucuggcauuagcgaaugcagauuccuuaaaauccgggaggggcgcauuaucaaggagauuuuucccaccggaagagugaagcacacagaagaguguaccugcggcuucgcuuccaacaaaaccaucgaaugugccugccgggauaauagcuauacagccaagcgcccguuugucaaacugaacguggagacggacaccgcugaaaucagacucaugugcacagagaccuaccuggauacaccucggcccaaugacgggucuauuaccggaccuugugaguccaacggcgauaaggggagcggaggcaucaaaggcggguucguucaucaacgcauggcgucuaagauuggaagaugguauagccggacgauguccaaaacaaagagaaugggcauggggcuguacgugaaguaugacggagaccccuggaccgauucugaagcccucgcucugagcggcgucaugguguccauggaggaacccgggugguacagcuuuggcuucgagaucaaagacaagaaaugcgaugugccuuguauuggaaucgaaaugguccacgacggcgggaagaccacauggcauucugccgccaccgcuaucuacugccuuaugggauccggccagcugcucugggauacaguuacgggggugaauaugacccuguga

SEQ ID NO: 211852 - RNA, 1401 nt, Artificial Sequence
  derived and/or modified sequence opt5 from neuraminidase__InfluenzaB__AEG21002
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugcgccacaccgaggaauguaccugcggauuugccagcaacaagacaauugagugugcuugcagagauaauuccuacacggccaaacggccuuucgucaaacuuaacguggaaaccgacacagccgagauccgccugaugugcaccgagacauaucucgauacccccagaccuaaugacggcagcaucacggggcccugugaaucuaacggagauaagggcuccgggggaauuaagggcggcuuuguucaucaacggauggcuagcaaaaucgggagaugguacucucgcacaaugagcaagaccaaacggaugggaaugggccuguaugugaaguacgacggggaccccuggaccgauuccgaggcgcuggcccucucuggagucauggugagcauggaggaaccuggcugguacuccuucggguuugaaauuaaggacaaaaagugcgaugugccguguaucggcauugagaugguccacgacggaggcaaaacaaccuggcauagcgcugccacagccaucuauugccugauggggucuggacagcuucugugggauacgguuaccggcgugaauaugacacucuga

SEQ ID NO: 211853 - RNA, 1401 nt, Artificial Sequence
  derived and/or modified sequence opt5 from neuraminidase__InfluenzaB__AEG21003
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucugauggagacaagggcuccgggggaauuaaaggcggcuuuguucaucaaagaauggcuagcaagaucgggcggugguacucuagaacaaugagcaaaaccaagcgcaugggaaugggccuguaugugaaguacgacggggaucccuggaccgacuccgaggcgcuggcccucucuggagucauggugagcauggaggaaccuggcugguacuccuucggguuugaaauuaaagauaagaaaugcgacgugccguguaucggcauugagaugguccacgauggaggcaagacaaccuggcauagcgcugccacagccaucuauugccugauggggucuggacagcuucugugggacacgguuaccggcgugaacaugacacucuga

SEQ ID NO: 211854 - RNA, 1401 nt, Artificial Sequence
  derived and/or modified sequence opt5 from neuraminidase__InfluenzaB__AEG21004
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggagggggcggcauuaaagggggauuuguccaucaacggauggaguccaagaucggccgcugguacagcagaaccaugucuaaaaccgaacggauggggaugggacuguaugugaaguacgacggcgaucccugggcugacagcgaugcgcuggccuucuccggggugauggucucuaugaaggagccuggcugguacagcuuuggauucgaaaucaaagacaagaaaugcgauguuccguguauuggcaucgagauggugcacgacgggggaaaggaaacauggcauuccgcugccaccgccauuuauugccucaugggcagcgggcagcugcuuugggauacagugacgggagucgacauggcucuguga

SEQ ID NO: 211855 - RNA, 1401 nt, Artificial Sequence
  derived and/or modified sequence opt5 from neuraminidase__InfluenzaB__AEG21005
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggagggggcggcauuaaagggggauuuguccaucaacggauggaguccaagaucggccgcugguacagcagaaccaugucuaaaaccgaacggauggggaugggacuguaugugaaguacgacggcgaucccugggcugacagcgaugcgcuggccuucuccggggugauggucucuaugaaggagccuggcugguacagcuuuggauucgaaaucaaagacaagaaaugcgauguuccguguauuggcaucgagauggugcacgacgggggaaaggaaacauggcauuccgcugccaccgccauuuauugccucaugggcagcgggcagcugcuuugggauacagugacgggagucaacaugacccuguga

SEQ ID NO: 211856 - RNA, 1401 nt, Artificial Sequence; identical to SEQ ID NO: 211841
  derived and/or modified sequence opt5 from neuraminidase__InfluenzaB__AEG21006

SEQ ID NO: 211857 - RNA, 1401 nt, Artificial Sequence; identical to SEQ ID NO: 211845
  derived and/or modified sequence opt5 from neuraminidase__InfluenzaB__AEG21007

SEQ ID NO: 211858 - RNA, 1401 nt, Artificial Sequence
  derived and/or modified sequence opt5 from neuraminidase__InfluenzaB__AEG21008
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggguccggaggcauuaaaggcggguuuguccaucaacggauggcuagcaagaucggacgcugguacucuagaaccaugagcaaaaccaagcggaugggcauggggcuguaugugaaguacgacggagaucccugggcggacuccgaugcccuggcuuucucuggcgugauggucagcaugaaagagccugggugguacuccuuuggcuucgaaaucaaggacaaaaagugcgauguuccguguauuggaaucgagauggugcacgacggcgggaaagaaacauggcauagcgccgccaccgcuauuuauugccucaugggaucuggccagcugcuuugggauacagugacgggggucgacauggcccuguga

SEQ ID NO: 211859 - RNA, 1401 nt, Artificial Sequence; identical to SEQ ID NO: 211845
  derived and/or modified sequence opt5 from neuraminidase__InfluenzaB__AEG21009

SEQ ID NO: 211860 - RNA, 1401 nt, Artificial Sequence; identical to SEQ ID NO: 211845
  derived and/or modified sequence opt5 from neuraminidase__InfluenzaB__AEG21010

SEQ ID NO: 211861 - RNA, 1401 nt, Artificial Sequence; identical to SEQ ID NO: 211845
  derived and/or modified sequence opt5 from neuraminidase__InfluenzaB__AEG21011

SEQ ID NO: 211862 - RNA, 1401 nt, Artificial Sequence; identical to SEQ ID NO: 211845
  derived and/or modified sequence opt5 from neuraminidase__InfluenzaB__AEG21012

SEQ ID NO: 211863 - RNA, 1401 nt, Artificial Sequence
  derived and/or modified sequence opt5 from neuraminidase__InfluenzaB__AEG21013
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggagaauagcaucuuccacauggccgcuugguccggaagcgccugccaugauggcaaagaguggaccuauauugggguugacggacccgauaacaaugcucugcuuaaggugaaauacggcgaagccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggaugaagucuaaaaucggacgcugguacucuagaaccaugagcaagaccgagcggaugggcauggggcuguaugugaaguacgacggagaucccugggcugacuccgaugcgcuggccuucucuggcgugauggucagcaugaaagaaccugggugguacuccuuuggcuucgagaucaaggacaaaaagugcgauguuccguguauuggaaucgaaauggugcacgacggcgggaaagagacauggcauagcgcugccaccgccauuuauugccucaugggaucuggccagcugcuuugggauacagugacgggggucgacauggcucuguga

SEQ ID NO: 211864 - RNA, 1401 nt, Artificial Sequence
  derived and/or modified sequence opt5 from neuraminidase__InfluenzaB__AEN68957
augcugcccagcaccauccagacacucacgcuguuccuuaccuccggcggggugcugcucucucuguacgucagcgccucccuuucuuaucugcucuacagcgacauucugcugaaguuuuccagaacagagaucccugcuccgauuaugccccucgauugcgccaacgcgucuaauguucaagcugugaaccggagcgccaccaaaggagugacacugcuucugccugaacccgaguggaccuauccucgccucuccugucccggcagcacauuccagaaggcccugcuuaucucuccucacagauuuggggaaaccaaaggaaauuccgcuccgcugauuauccgggagcccuucaucgccugcggcccuaaggaauguaaacauuuugcucucacgcacuacgccgcgcagcccgggggauauuacaacggcacccgcgaggacagaaauaagaugcggcaucugauuagcgucaagcugggcaaaaucccuacaguggagaacucuauuuuccacauggccgcuugguccgggagcgccugccaugauggacgcgaauggaccuauaucggcguugacgggcccgauucuaaugcucuccugaagauuaaauacggagaggccuacacagacaccuaucacuccuacgcgaagaacauccuuagaacgcaggaaagcgccuguaauugcauuggcggggauuguuaucugaugaucacagacggaccggcuuccggcaucucugagugccgguuucucaaaauucgcgagggcagaaucauuaaggaaaucuucccuaccgggcgggugaaguacacagaggaauguaccugcggauuugccagcaacaaaaccauuggcugugcuugccgcgauaauuccuauacagccaagagacccuucgucaaacugaacguggagacggacaccgccgaaauccggcuuaugugcacagagaccuaccuggauacaccucgccccaaugacgggagcaucaccggacccugugagucuaacggcgauaagggguccggaggcauuaaaggcggguuuguucaccaaagaauggcuagcaagaucggacggugguauucuagaacgaugagcaaaacaaagcgcaugggcauggggcucuacgugaaguacgacggagacccuuggaccgauuccgaagcgcuggcccugucuggcgucauggugagcauggaggaaccggggugguauuccuucggcuuugagauuaaagacaagaaaugcgaugugcccuguaucggaauugaaaugguccaugacggcgggaagaccacauggcacagcgcugccaccgccaucuacugccucaugggaucuggccagcugaugugggauacaguuacgggggugaauaugacccuuuga

SEQ ID NO: 211865 - RNA, 1401 nt, Artificial Sequence
  derived and/or modified sequence opt5 from neuraminidase__InfluenzaB__AEO80071
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaccagcggauggcuagcaaaaucggacgcugguacucuagaaccaugagcaagaccgagcggaugggcauggggcuguaugucaaauacgacggagaucccugggcggacuccgaugcccuggcuuucucuggcgugauggugagcaugaaggaaccugggugguacuccuuuggcuucgagauuaaggacaaaaagugcgaugucccguguaucggaauugaaaugguucaugacggcgggaaagagacauggcacagcgccgccaccgcuaucuauugccucaugggaucuggccaacugcuuugggauacagugacggggguggacauggcccuguga

SEQ ID NO: 211866 - RNA, 1401 nt, Artificial Sequence
  derived and/or modified sequence opt5 from neuraminidase__InfluenzaB__AEO80082
augcugcccagcaccauccagacacucacgcuguuccuuaccuccggcggggugcugcucucucuguacgucagcgccucccuuucuuaucugcucuacagcgacauucugcugaaguuuucccaaacaggaaucaccgcuccuauuaugccgcucgauugcgccaacgcgucuaauguucaggcugugaacagaagcgccacaaaaggcgugacccugcuucugcccgagccugaauggacauauccccggcucuccuguccugggagcaccuuccagaaggcccugcuuaucucuccccaccgcuuuggagagacgaaaggcaauuccgcuccucugauuaucagagaaccguucaucgccugcgggcccaccgaguguaaguacuuugcucucacacauuaugccgcgcagccuggaggcuacuauaacggcacccgggaagaccgcaauaaacugagacaccugauuagcgucaagcucgggaagauccccacaguggagaacucuauuuuccauauggccgcuugguccggaagcgccugccacgauggcaaagaguggaccuacaucgggguugacggaccugauucuaaugcucugcuuaagauuaaauacggcgaagccuauacggacacauaccauuccuaugcgaagaacauccugcggacccaagagagcgccuguaauugcauugggggagauuguuaccucaugaucacagacggccccgcuuccggcaucucugaaugccgcuuucugaaaauuagagaggggcggaucauuaaggagaucuucccgaccggacgcgugaagcacaccgaagaguguacaugcggcuuugccagcaacaaaacgauugaaugugcuugcagagauaauuccuauaccgccaagcggccuuucgucaaacuuaacguggagacagacaccgccgaaauccgccugaugugcacagagaccuaccucgauacgcccagaccuaaugacgggagcaucacaggacccugugagucugauggcgacaagggguccggaggcauuaaaggcggguuuguucaccagcggauggcuagcaagaucggacgcugguauucuagaaccaugagcaaaaccaagcggaugggcauggggcuguacgugaaguacgacggagaucccuggacagacuccgaagcgcuggcccucucuggcgucauggugagcauggaggaaccugggugguauuccuucggcuuugagauuaaagauaagaaaugcgacgugccguguaucggaauugaaaugguccaugauggcgggaagaccacauggcacagcgcugccacggccaucuacugccugaugggaucuggccagcuucugugggacaccguuacagggguggauauggcucucuga

SEQ ID NO: 211867 - RNA, 1401 nt, Artificial Sequence; identical to SEQ ID NO: 211706
  derived and/or modified sequence opt5 from neuraminidase__InfluenzaB__AEO80090

SEQ ID NO: 211868 - RNA, 1401 nt, Artificial Sequence; identical to SEQ ID NO: 211651
  derived and/or modified sequence opt5 from neuraminidase__InfluenzaB__AEO80101

SEQ ID NO: 211869 - RNA, 1401 nt, Artificial Sequence; identical to SEQ ID NO: 211747
  derived and/or modified sequence opt5 from neuraminidase__InfluenzaB__AEO80149

SEQ ID NO: 211870 - RNA, 1401 nt, Artificial Sequence; identical to SEQ ID NO: 211659
  derived and/or modified sequence opt5 from neuraminidase__InfluenzaB__AEO80158

SEQ ID NO: 211871 - RNA, 1401 nt, Artificial Sequence; identical to SEQ ID NO: 211659
  derived and/or modified sequence opt5 from neuraminidase__InfluenzaB__AEO80167

SEQ ID NO: 211872 - RNA, 1401 nt, Artificial Sequence; identical to SEQ ID NO: 211747
  derived and/or modified sequence opt5 from neuraminidase__InfluenzaB__AEO80176

SEQ ID NO: 211873 - RNA, 1401 nt, Artificial Sequence
  derived and/or modified sequence opt5 from neuraminidase__InfluenzaB__AEO80187
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucggaugcgccaacgcgucuaauguucaagcugugaacagaagcgccaccaaaggcgugacacugcuucugccugaacccgaguggaccuauccucggcucuccugucccgggagcacguuccagaaggcccugcuuauuucuccucaccgcuuuggagaaaccaaaggcaauuccgcuccgcugaucauuagagagcccuucaucgccugcgggccuaacgaauguaagcauuuugcucucacacacuacgccgcgcagcccggaggcuauuacaauggcacccgcggggaucggaacaaacugagacaucugaucagcgucaagcucggaaagauuccuacaguggaaaauucuaucuuccacauggccgcuugguccggcagcgccugccaugacgggaaagaguggaccuauauuggaguugauggccccgacaacaaugcucugcuuaagaucaaauacggggaggccuacacggauacauaucacucuuacgcgaacaagauucugcggacccaggaguccgccuguaauugcaucggaggcaacuguuaucucaugauuacagacggcagcgcuuccggggugucugaaugccgcuuucugaaaaucagagagggacggaucauuaaggagaucuucccgaccggccgcgucaagcacaccgaagaguguacaugcggguuugccagcaauaaaacgauugaaugugcuugcagagauaacuccuacaccgccaagcggccuuucgugaaacuuaauguugagacagacaccgccgaaauccgccugaugugcacagauaccuaucucgacacgcccagaccugaugacggaagcauuacaggccccugugagucuaacggggaucggggauccggcggcaucaaagggggauuugugcaucaacgcauggcuagcaagaucggcagaugguacucucggaccaugagcaagaccgagagaauggggaugggacuguaugucaaauacgacggcgaccccugggcggauuccgacgcccuggcuuucucuggggugauggugagcaugaaggaaccuggcugguacuccuuuggauucgagauuaaggauaaaaagugcgacgucccguguaucggcauugaaaugguucacgaugggggaaaagagacauggcauagcgccgccaccgcuaucuauugccucaugggcucugggcagcugcuuugggacacagugacgggaguggauauggcccuguga

SEQ ID NO: 211874 - RNA, 1401 nt, Artificial Sequence
  derived and/or modified sequence opt5 from neuraminidase__InfluenzaB__AEO80198
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgaccggggguccggaggcaucaagggcggguuugugcaucaacgcauggcuagcaaaaucggaagaugguacucucggaccaugagcaagaccgagagaaugggcauggggcuguaugucaaauacgacggagaucccugggcggacuccgaugcccuggcuuuccgcggcgugauggugucuaugaaggaaccugggugguacagcuuuggcuucgagauuaaggacaaaaagugcgaugucccguguaucggaauugaaaugguucacgacggcgggaaagagacauggcauuccgccgccaccgcuaucuauugccucaugggaagcggccagcugcuuugggauacagugacggggguggacauggcccuguga

SEQ ID NO: 211875 - RNA, 1401 nt, Artificial Sequence; identical to SEQ ID NO: 211815
  derived and/or modified sequence opt5 from neuraminidase__InfluenzaB__AEO80209

SEQ ID NO: 211876 - RNA, 1401 nt, Artificial Sequence
  derived and/or modified sequence opt5 from neuraminidase__InfluenzaB__AEO80220
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggacugacacuucugcucccugaacccgaguggaccuauccucggcuguccugucccggcagcacguuccagaaggcccuucugauuucuccucaccgcuuuggggaaaccaaaggaaauuccgcuccgcucaucauuagagagcccuucaucgccugcggcccuaacgaauguaagcauuuugcucugacacacuacgccgcgcagcccgggggauauuacaauggcacccggggcgaccgcaacaaacugagacaucucaucagcgugaagcuggggaagauuccuacagucgagaccucuaucuuccacauggccgcuugguccggaagcgccugccaugauggcaaagaguggacguauauugggguggacggacccgauaauaacgcucugcuuaagaucaaauacggcgaagccuacacagacaccuaucacucuuacgcgaauaagauucuccggacacaggaguccgccuguaacugcaucgggggaaauuguuaucugaugauuaccgauggcagcgcuuccggcguuucugaaugccgcuuucuuaaaaucagagaggggcggaucauuaaggagaucuucccgaccggacgcgugaagcacacagaagaguguacgugcggcuuugccagcaacaaaaccauugaaugugcuugcagagacaauuccuacacagccaagcggccuuucgucaaacugaacguggagaccgauacagccgaaauccgccucaugugcaccgacacguaucuggauacacccagaccugacgaugggagcauuaccggacccugugagucuaauggcgaccggggguccggaggcaucaagggcggguuuguucaucaacgcauggcuagcaaaaucggaagaugguacucucggaccaugagcaagacagagagaaugggcauggggcuguaugugaaauacgacggagaucccugggcggacuccgaugcccucgcuuucucuggcgucauggugagcaugaaggaaccugggugguacuccuuuggcuucgagauuaaggacaaaaagugcgaugugccguguaucggaauugaaaugguccacgacggcgggaaagagaccuggcauagcgccgccacagcuaucuauugccugaugggaucuggccagcuucugugggauacgguuaccgggguggacauggcccucuga

SEQ ID NO: 211877 - RNA, 1401 nt, Artificial Sequence; identical to SEQ ID NO: 211812
  derived and/or modified sequence opt5 from neuraminidase__InfluenzaB__AEO80231

SEQ ID NO: 211878 - RNA, 1401 nt, Artificial Sequence; identical to SEQ ID NO: 211815
  derived and/or modified sequence opt5 from neuraminidase__InfluenzaB__AEO80242

SEQ ID NO: 211879 - RNA, 1401 nt, Artificial Sequence; identical to SEQ ID NO: 211659
  derived and/or modified sequence opt5 from neuraminidase__InfluenzaB__AEP20182

SEQ ID NO: 211880 - RNA, 1401 nt, Artificial Sequence
  derived and/or modified sequence opt5 from neuraminidase__InfluenzaB__AEP20193
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaccagcggauggcuagcaaaaucggacgcugguacucuagaaccaugagcaagaccgagcggaugggcauggggcuguaugucaaauacgacggagaucccugggcggacuccgaugcccuggcuuucucuggcgugauggugagcgucaaggaaccugggugguacuccuuuggcuucgagauuaaggacaaaaagugcgauguuccguguaucggaauugaaauggugcaugacggcgggaaagagacauggcacagcgccgccaccgcuaucuauugccucaugggaucuggccaacugcuuugggauacagugacgggggucgacauggcccuguga

SEQ ID NO: 211881 - RNA, 1401 nt, Artificial Sequence
  derived and/or modified sequence opt5 from neuraminidase__InfluenzaB__AEP20204
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggcuagcaagaucggacgcugguacucuagaaccaugagcaaaaccgagcggaugggcauggggcuguaugucaaguacgacggagaucccugggcggacuccgaugcccuggcuuucucuggcgugauggugagcauuaaggaaccugggugguacuccuuuggcuucgagaucaaagacaagaaaugcgaugucccguguauuggaaucgaaaugguucacgacggcgggaaggagacauggcauagcgccgccaccgcuauuuauugccucaugggaucuggccagcugcuuugggauacagugacggggguggacauggcccuguga

SEQ ID NO: 211882 - RNA, 1401 nt, Artificial Sequence; identical to SEQ ID NO: 211711
  derived and/or modified sequence opt5 from neuraminidase__InfluenzaB__AEP20215

SEQ ID NO: 211883 - RNA, 1401 nt, Artificial Sequence
  derived and/or modified sequence opt5 from neuraminidase__InfluenzaB__AEP20237
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagaugccgcugaaauucgccugaugugcaccgagacauaucucgacacccccagaccugaugacgggucuaucacgggacccugugaguccaauggcgauaaggggagcggaggcaucaaaggcggguuuguucaucaacggauggcgucuaagauuggacgcugguacagcagaacaauguccaaaaccaagcggaugggcauggggcuguaugugaaguacgacggagaccccuggaccgauucugacgcccuggcucucagcggcgucaugguguccauggaggaaccugggugguacagcuucggcuuugaaaucaaagauaagaaaugcgacgugccguguauuggaaucgagaugguccacgauggcgggaaggaaacauggcauucugccgccaccgcuauuuauugccugaugggauccggccagcuucugugggacacaguuacggggguggauauggcccucuga

SEQ ID NO: 211884 - RNA, 1401 nt, Artificial Sequence; identical to SEQ ID NO: 211711
  derived and/or modified sequence opt5 from neuraminidase__InfluenzaB__AEP20248

SEQ ID NO: 211885 - RNA, 1401 nt, Artificial Sequence
  derived and/or modified sequence opt5 from neuraminidase__InfluenzaB__AEP20259
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagauuaucgaaugugcuugcagagacaauuccuacacggccaaacggccuuucgugaaacuuaacguugagaccgauacagccgaaauucgccugaugugcaccgagacauaucucgacacccccagaccugaugacgggagcaucacgggacccugugagucuaacggcgauaagggguccggaggcaucaagggcggguuugugcaucaacggauggcuagcaaaauuggacgcugguacucuagaacaaugagcaagaccgaacggaugggcauggggcuguaugucaaauacgacggagaccccugggcggauuccgacgcccuggcucucucuggcgugauggugagcauggaggaaccugggugguacuccuucggcuuugagaucaaggauaagaaaugcgacgucccguguauuggaaucgaaaugguucacgauggcgggaaggagaccuggcauagcgccgccacagcuauuuauugccugaugggaucuggccagcuucugugggacaccgugacagggguggauauggcccucuga

SEQ ID NO: 211886 - RNA, 1401 nt, Artificial Sequence
  derived and/or modified sequence opt5 from neuraminidase__InfluenzaB__AEP20281
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcaccacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaacgaauguaagcauuuugcccucacccacuacgcugcccagcccgggggauauuacaauggcacacggggcgaccgcaacaaacugagacaucugaucagcgucaagcucgggaagauuccuaccguggaaaauucuaucuuccacauggcggccugguccggaagcgcuugccaugauggcaaagaguggacguauauugggguugacggacccgauaacaaugcccugcuuaagaucaaauacggcgaggcuuacacagacaccuaucacucuuacgccaacaauauucugcggacacaggaguccgcguguaacugcaucgggggaaauuguuaucucaugauuaccgauggcagcgccuccggcgugucugaaugccgcuuucugaagaucagagaggggcggaucauuaaagagaucuucccgaccggacgcgucaagcacacagaagaguguacgugcggcuuugcuagcaacaagaccauugaaugugccugcagagacaauuccuacacagcuaaacggccuuucgugaaacuuaacguugagaccgauacagccgaaauccgccugaugugcaccgagacguaucucgacacacccagaccugaugacgggagcauuaccggacccugugagucuaacggcgauaagggguccggaggcaucaagggcggguuugugcaucaacggauggccagcaaaaucggacgcugguacucuagaaccaugagcaagacagaacggaugggcauggggcuguaugucaaauacgacggagaccccugggcugauuccgacgcgcuggcccucucuggcgugauggugagcauggaggaaccugggugguacuccuucggcuuugagauuaaggauaagaaaugcgacgucccguguaucggaauugaaaugguucacgauggcgggaaggagaccuggcauagcgcugccacagccaucuauugccugaugggaucuggccagcuucugugggacacggugaccgggguggauauggcucucuga

SEQ ID NO: 211887 - RNA, 1401 nt, Artificial Sequence; identical to SEQ ID NO: 211659
  derived and/or modified sequence opt5 from neuraminidase__InfluenzaB__AEP20292

SEQ ID NO: 211888 - RNA, 1401 nt, Artificial Sequence; identical to SEQ ID NO: 211651
  derived and/or modified sequence opt5 from neuraminidase__InfluenzaB__AEP20303

SEQ ID NO: 211889 - RNA, 1401 nt, Artificial Sequence
  derived and/or modified sequence opt5 from neuraminidase__InfluenzaB__AEP20314
augcugcccagcaccauccagacacucacgcuguuccuuaccuccggcggggugcugcucucucuguacgucagcgccucccuuucuuaucugcucuacagcgacauucugcugaaguuuucccaaacaggaaucaccgcuccuauuaugccgcucgauugcgccaacgcgucuaauguucaggcugugaacagaagcgccacaaaaggcgugacccugcuucugcccgagccugaauggacauauccccggcucuccuguccugggagcaccuuccagaaggcccugcuuaucucuccccaccgcuuuggagagacgaaaggcaauuccgcuccucugauuaucagagaaccguucaucgccugcgggcccaaggaguguaaacauuuugcucucacccacuacgccgcgcagccuggaggcuauuacaacggcacacgggaagaccgcaauaagcugagacaucugauuagcgucaagcucgggaaaauccccaccguggagaacucuauuuuccacauggccgcuugguccggaagcgccugccaugauggccgggaguggacauauaucgggguugacggaccugauucuaaugcucugcuuaagauuaaauacggcgaagccuacaccgacacguaucacuccuacgcgaagaacauccugcgcacacaagagagcgccuguaauugcauugggggagauuguuaucucaugaucaccgacggccccgcuuccggcaucucugaaugcagauuucugaaaauucgggaggggcgcaucauuaaggagaucuucccgacaggaagagugaagcacaccgaagaguguaccugcggcuuugccagcaacaaaacaauugaaugugcuugccgggauaauuccuacacggccaagcgcccuuucgucaaacuuaacguggagaccgacacagccgaaaucagacugaugugcaccgagacauaucucgauacgccccggccuaaugacgggagcaucaccggacccugugagucuaacggcgauaagggguccggaggcauuaaaggcggguuuguucaucagcgcauggcuagcaagaucggaagaugguacucucggacaaugagcaaaaccaagagaaugggcauggggcuguaugugaaguacgacggagaccccuggaccgauuccgaagcgcuggcccucucuggcgucaugauuagcauggaggaaccugggugguacuccuucggcuuugagaucaaagacaagaaaugcgaugugccguguauuggaaucgaaauggugcacgacggcgggaagacaaccuggcauagcgcugccacagccaucuauugccugaugggaucuggccagcuucugugggauacggucaccgggguugacauggcucucuga

SEQ ID NO: 211890 - RNA, 1401 nt, Artificial Sequence
  derived and/or modified sequence opt5 from neuraminidase__InfluenzaB__AEP20336
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagagaccuaucucgacacgcccagaccugaugacgggagcauuacaggacccugugagucuaacggcgauaagggguccggaggcaucaagggcggguuugugcaucaacggauggcuagcaaaaucggacgcugguacucuagaaccaugagcaagaccgaacggaugggcauggggcuguaugucaaauacgacggagaccccugggcggauuccgacgcccugacacucucuggcgugauggugagcauggaggaaccugggugguacuccuucggcuuugagauuaaggauaagaaaugcgacgucccguguaucggaauugaaaugguucacgauggcgggaaggagaccuggcauagcgcugccacaucuaucuauugccugaugggauccggccagcuucugugggacacggugaccgggguggauauggcccucuga

SEQ ID NO: 211891 - RNA, 1401 nt, Artificial Sequence
  derived and/or modified sequence opt5 from neuraminidase__InfluenzaB__AEP20347
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccuguaugugaaguacgacggggaucccuggacagacuccgaggcgcuggcccucucuggagucauggugccuauggaggaaccgggcugguacagcuucggguuugaaauuaaagauaagaaaugcgacgugcccuguaucggcauugagaugguccacgauggaggcaagaccacauggcauuccgcugccacggccaucuauugccugauggggagcggacagcuucugugggacaccguuacaggcguggauauggcucucuga

SEQ ID NO: 211892 - RNA, 1401 nt, Artificial Sequence; identical to SEQ ID NO: 211891
  derived and/or modified sequence opt5 from neuraminidase__InfluenzaB__AEP20358

SEQ ID NO: 211893 - RNA, 1401 nt, Artificial Sequence; identical to SEQ ID NO: 211891
  derived and/or modified sequence opt5 from neuraminidase__InfluenzaB__AEP20369

SEQ ID NO: 211894 - RNA, 1401 nt, Artificial Sequence; identical to SEQ ID NO: 211891
  derived and/or modified sequence opt5 from neuraminidase__InfluenzaB__AEP20380

SEQ ID NO: 211895 - RNA, 1401 nt, Artificial Sequence
  derived and/or modified sequence opt5 from neuraminidase__InfluenzaB__AEP20391
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacagacugcggcaucugaucagcgucaaacucgggaagauuccuacaguggaaaauucuaucuuccacauggccgcuugguccggaagcgccugccaugauggcaaggaguggaccuauauugggguugacggacccgauaacaaugcucugcuuaaaaucaaguacggcgaggccuacacggacacauaucacucuuacgcgaacaauauucugcgcacccaggaguccgccuguaacugcaucgggggaaauuguuaucucaugauuacagauggcagcgcuuccggcgugucugaaugcagauuucugaaaauccgggaggggcgcaucauuaaggagaucuucccgaccggaagagucaaacacaccgaagaguguacaugcggcuuugccagcaacaagacgauugaaugugcuugccgggacaauuccuacaccgccaagcgcccuuucgugaaacuuaacguugagacagauaccgccgaaaucagacugaugugcacagacaccuaucucgauacgccccggccugacgaugggagcauuacaggacccugugagucuaacggcgacaagggguccggaggcaucaaaggcggguuugugcaucaacgcauggcuagcaaggucggaagaugguacucucggaccaugagcaaaaccgagagaaugggcauggggcuguaugugaaguacgacggagaucccugggcggacuccgaugcccuggcuuucucuggcgugauggucagcaugaaagaaccugggugguacuccuuuggcuucgagaucaaggacaagaaaugcgauguuccguguauuggaaucgaaauggugcacgacggcgggaaggagacauggcauagcgccgccaccgcuauuuauugccucaugggaucuggccagcugcuuugggauacagugacgggggucgacauggcccuguga

SEQ ID NO: 211896 - RNA, 1401 nt, Artificial Sequence
  derived and/or modified sequence opt5 from neuraminidase__InfluenzaB__AEP20413
augcugcccagcaccauccagacacucacgcuguuccuuaccuccggcggggugcugcucucucuguacgucagcgcccuucuguccuaucuccuguacucugacauucugcucaaguuuagcccuacagagaucauugcuccgaccaugucccuggauugcgccaacgcgucuaauguucaagcugugaacagaagcgccacaaaaggagugaccuuccuucugcccgaaccugaguggacauauccccggcucuccuguccuggcagcaccuuucagaaggcccugcuuaucucuccccaccgcuucggggaaacgaaaggaaauuccgcuccucugauuaucagagagccguuuaucgccugcggccccaacgaauguaagcauuucgcucucacccacuacgccgcgcagccugggggauauuacaauggcacacggggcgaccgcaacaaacugagacaucugauuagcgucaagcucgggaagauccccaccguggaaaauucuauuuuucacauggccgcuugguccggaagcgccugccaugauggcaaagaguggacauauaucgggguugacggaccugauaacgacgcucugcuuaaggugaaauacggcgaggccuacaccgauacguaucacucuuacgcgaauaagauucugcggacacaggaguccgccuguaacugcaucgggggaaauuguuaucucaugauuaccgacggcagcgcuuccggcgucucugaaugccgcuuccugaaaaucagagaggggcggaucauuaaggagaucuuucccacaggacgcgugaagcacaccgaagaguguaccugcggcuucgccagcaacaaaacaauugaaugugcuugcagagauaauuccuacacggccaagcggccguuuguuaaacuuaacguggagaccgacacagccgaaauccgccugaugugcaccgauacauaucucgacaccccuagacccgaugacgggagcauuacgggaccuugugagucuaauggcgacaagggguccggaggcaucaaaggcggguucguccaucaacggauggagagcaagaucggacgcugguacucuagaacaaugagcaaaaccgaacggaugggcauggggcuguaugugaaguacaacggagaucccugggcugacuccgaugcgcuggccuuuucuggcgugauggucagcaugaaggagcccgggugguacuccuucggcuucgaaauuaaagacaagaaaugcgauguuccuuguaucggaauugagauggugcacgacggcgggaaggaaaccuggcauagcgcugccacagccaucuauugccucaugggaucuggccagcugcuuugggauaccgugacaggggucgacauggcucuguga

SEQ ID NO: 211897 - RNA, 1401 nt, Artificial Sequence; identical to SEQ ID NO: 211896
  derived and/or modified sequence opt5 from neuraminidase__InfluenzaB__AEP20435

SEQ ID NO: 211898 - RNA, 1401 nt, Artificial Sequence; identical to SEQ ID NO: 211891
  derived and/or modified sequence opt5 from neuraminidase__InfluenzaB__AEQ39031

SEQ ID NO: 211899 - RNA, 1401 nt, Artificial Sequence
  derived and/or modified sequence opt5 from neuraminidase__InfluenzaB__AEQ39275
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacccgaguggacauauccuagacucuccugucccggcagcaccuuccagaaagcccugcuuauuucuccucaucgguuuggggaaacgaagggaaauuccgcuccgcugaucauucgcgagcccuucaucgccugcggcccuaacgaauguaaacacuuugcucucacccauuacgccgcgcagcccgggggauauuacaauggcacaagaggcgaccggaacaagcugcgccaccugaucagcgucaagcucgggaaaauuccuaccguggaaaauucuaucuuccauauggccgcuugguccggaagcgccugccacgauggcaaggaguggacauauauugggguugacggacccgauaacaaugcucugcuuaaagugaaguacggcgaggccuacaccgacacguaucacucuuacgcgaacaaaauccugagaacacaggaguccgccuguaauugcauugggggaaacuguuaucucaugaucaccgauggcagcgcuuccggcgucucugaaugccgguuucugaagauucgcgaggggagaaucaucaaggagauuuucccgacaggacgggugaaacauaccgaagaguguaccugcggcuuugccagcaauaagacaaucgaaugugcuugccgcgacaacuccuacacggccaaaagaccuuucguuaaacuuaauguggagaccgauacagccgaaauucggcugaugugcaccgacacauaucucgauacgccccgcccugacgaugggagcaucaccggacccugugagucuaacggcgacaagggguccggaggcauuaagggcggguuuguccaccaaagaauggagagcaaaaucggacggugguacucucgcacaaugagcaagaccgaaagaaugggcauggggcuguaugugaaguacgacggagaucccugggcugacuccgaugcgcuggccuucucuggcgugauggucagcaugaaagagccugggugguacuccuuuggcuucgaaaucaaggacaaaaagugcgauguuccguguauuggaaucgagauggugcaugacggcgggaaagaaaccuggcacagcgcugccacagccauuuauugccucaugggaucuggccagcugcuuugggauaccgugacaggggucgacauggcucuguga

SEQ ID NO: 211900 - RNA, 1401 nt, Artificial Sequence; identical to SEQ ID NO: 211899
  derived and/or modified sequence opt5 from neuraminidase__InfluenzaB__AEQ39286

SEQ ID NO: 211901 - RNA, 1401 nt, Artificial Sequence; identical to SEQ ID NO: 211899
  derived and/or modified sequence opt5 from neuraminidase__InfluenzaB__AEQ39297

SEQ ID NO: 211902 - RNA, 1401 nt, Artificial Sequence; identical to SEQ ID NO: 211899
  derived and/or modified sequence opt5 from neuraminidase__InfluenzaB__AEQ39308

SEQ ID NO: 211903 - RNA, 1401 nt, Artificial Sequence; identical to SEQ ID NO: 211899
  derived and/or modified sequence opt5 from neuraminidase__InfluenzaB__AEQ39319

SEQ ID NO: 211904 - RNA, 1401 nt, Artificial Sequence
  derived and/or modified sequence opt5 from neuraminidase__InfluenzaB__AEQ39330
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacccgaguggacauauccuagacucuccugucccggcagcaccuuccagaaagcccugcuuauuucuccucaucgguuuggggaaacgaagggaaauuccgcuccgcugaucauucgcgagcccuucaucgccugcggcccuaacgaauguaaacacuuugcucucacccauuacgccgcgcagcccgggggauauuacaauggcacaagaggcgaccggaacaagcugcgccaccugaucagcgucaagcucgggaaaauuccuaccguggaaaauucuaucuuccauauggccgcuugguccggaagcgccugccacgauggcaaggaguggacauauauugggguugacggacccgauaacaaugcucugcuuaaagugaaguacggcgaggccuacaccgacacguaucacucuuacgcgaacaaaauccugagaacacaggaguccgccuguaauugcauugggggaaacuguuaucucaugaucaccgauggcagcgcuuccggcgucucugaaugccgguuucugaagauucgcgaggggagaaucaucaaggagauuuucccgacaggacgggugaaacauaccgaagaguguaccugcggcuuugccagcaauaagacaaucgaaugugcuugccgcgacaacuccuacacggccaaaagaccuuucguuaaacuuaauguggagaccgauacagccgaaauucggcugaugugcaccgacacauaucucgauacgccccgcccugacgaugggagcaucaccggacccugugagucuaacggcgacaagggguccggaggcauuaagggcggguuuguccaccaaagaauggagagcaaaaucggacggugguacucucgcacaaugagcaagaccgaaagaaugggcauggggcuguaugugaaguacgacggagaucccugggcugacuccgaugcgcuggccuucucuggcgugauggucagcaugaaagagccugggugguacuccuuuggcuucgaaaucaaggacaaaaagugcgauguuccguguauuggaaucgagauggugcaugacggcgggaaagaaaccuggcacagcgcugccacagccauuuauugccucaugggaucuggccagcugcuuugggauaccgugacaggggucgacaucgcucuguga

SEQ ID NO: 211905 - RNA, 1401 nt, Artificial Sequence; identical to SEQ ID NO: 211899
  derived and/or modified sequence opt5 from neuraminidase__InfluenzaB__AEQ39341

SEQ ID NO: 211906 - RNA, 1401 nt, Artificial Sequence; identical to SEQ ID NO: 211899
  derived and/or modified sequence opt5 from neuraminidase__InfluenzaB__AEQ39352

SEQ ID NO: 211907 - RNA, 1401 nt, Artificial Sequence; identical to SEQ ID NO: 211899
  derived and/or modified sequence opt5 from neuraminidase__InfluenzaB__AEQ39363

SEQ ID NO: 211908 - RNA, 1401 nt, Artificial Sequence; identical to SEQ ID NO: 211865
  derived and/or modified sequence opt5 from neuraminidase__InfluenzaB__AEQ39374

SEQ ID NO: 211909 - RNA, 1401 nt, Artificial Sequence
  derived and/or modified sequence opt5 from neuraminidase__InfluenzaB__AEQ39385
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacccugugaguccaauggcgauaaggggagcggaggcaucaaaggcggguuuguucaucaacggaugaccucuaagauuggacgcugguacagcagaaccauguccaaaacaaagcggaugggcauggggcuguaugugaaguacgacggagaccccuggaccgauucugacgcucuggcgcucagcggcgucaugguguccauggaggaaccugggugguacagcuucggcuuugaaaucaaagauaagaaaugcgacgugccguguauuggaaucgagaugguccacgauggcgggaaggaaacauggcauucugccgcuacggccauuuauugccugaugggauccggccagcuucugugggacaccguuacagggguggauauggcccucuga

SEQ ID NO: 211910 - RNA, 1401 nt, Artificial Sequence
  derived and/or modified sequence opt5 from neuraminidase__InfluenzaB__AEQ39444
augcugcccagcaccauccagacacucacgcuguuccuuaccuccggcggggugcugcucucucuguacgucagcgccucccuuucuuaucugcucuacagcgacauucugcugaaguuuucccaaacagagaucauugcuccuaucaugccgcucgauugcgccaacgcgucuaauguucaggcugugaacagaagcgccaccaaaggagugacacugcuucugcccgaaccugaguggaccuauccccggcucuccuguccuggcagcacauuccagaaggcccugcuuauuucuccccaccgcuuuggggaaaccaaaggaaauuccgcuccucugaucaucagagagccguucauugccugcggccccacggaauguaagcauuuugcucucacccacuacgccgcgcagccugggggauauuacaacggcacacgggaggaccgcaauaaacugagacaucugaucagcgucaagcucggcaagauucccaccguggagaacucuaucuuccacauggccgcuugguccgggagcgccugccaugauggaaaagaauggacauauauuggcguugacgggccugauucuaaugcucugcuuaagaucaaauacggagaggccuacaccgacacguaucacuccuacgcgaagaacauucugcggacacaagaaagcgccuguaauugcaucggcggggauuguuaucucaugaucaccgacggacccgcuuccggcauuucugagugccgcuuucugaaaaucagagagggccggauuaucaaggaaauuuucccgacagggcgcgugaagcacaccgaggaauguaccugcggauuugccagcaacaaaacaaucgagugugcuugcagagauaauuccuacacggccaagcggccuuucgucaaacuuaacguggaaaccgacacagccgagauccgccugaugugcaccgagacauaucucgauacccccagaccuaaugacggcagcauuacggggcccugugaaucugauggagacaagggcuccgggggaaucaaaggcggcuuuguucaucagcggauggcuagcaagauugggcgcugguacucuagaacaaugagcaaaaccaagcggaugggaaugggccuguaugugaaguacgacggggaucccuggaccgacuccgaggcgcuggcccucucuggagucauggugagcauggaggaaccuggcugguacuccuucggguuugaaaucaaagauaagaaaugcgacgugccguguauuggcaucgagaugguccacgauggaggcaagacaaccuggcauagcgcugccacagccaucuauugccugauggggucuggacagcuucugugggacacgguuaccggcguggauauggcucucuga

SEQ ID NO: 211911 - RNA, 1401 nt, Artificial Sequence; identical to SEQ ID NO: 211812
  derived and/or modified sequence opt5 from neuraminidase__InfluenzaB__AEQ39455

SEQ ID NO: 211912 - RNA, 1401 nt, Artificial Sequence
  derived and/or modified sequence opt5 from neuraminidase__InfluenzaB__AEQ39466
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaucaacggauggcuagcaaagucggacgcugguacucuagaaccaugagcaagaccgagcggaugggcauggggcuguaugugaaauacgacggagaucccugggcggacuccgaugcccuggcuuucucuggcgugauggucagcaugaaggaaccugggugguacuccuuuggcuucgagaucaaggacaaaaagugcgauguuccguguauuggaaucgaaauggugcacgacggcgggaaagagacauggcauagcgccgccaccgcuauuuauugccucaugggaucuggccagcugcuuugggauacagugacgggggucgacauggcccuguga

SEQ ID NO: 211913 - RNA, 1401 nt, Artificial Sequence; identical to SEQ ID NO: 211899
  derived and/or modified sequence opt5 from neuraminidase__InfluenzaB__AEQ39477

SEQ ID NO: 211914 - RNA, 1401 nt, Artificial Sequence
  derived and/or modified sequence opt5 from neuraminidase__InfluenzaB__AEQ39488
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagccgcaucggaagaugguacucucggaccaugagcaagaccgaaagaaugggcauggggcuguaugugaaauacgacggagaccccuggacagauuccgacgcucuggcguucucuggcgugauggucagcaugaaggagccugggugguacuccuuuggcuucgaaaucaaggauaaaaagugcgacguuccguguauuggaaucgagauggugcacgauggcgggaaagaaaccuggcauagcgccgcuacagccauuuauugccucaugggaucuggccagcugcuuugggacacggugaccggggucgauauggcccuguga

SEQ ID NO: 211915 - RNA, 1401 nt, Artificial Sequence; identical to SEQ ID NO: 211865
  derived and/or modified sequence opt5 from neuraminidase__InfluenzaB__AEQ39499

SEQ ID NO: 211916 - RNA, 1401 nt, Artificial Sequence; identical to SEQ ID NO: 211711
  derived and/or modified sequence opt5 from neuraminidase__InfluenzaB__AEQ39510

SEQ ID NO: 211917 - RNA, 1401 nt, Artificial Sequence
  derived and/or modified sequence opt5 from neuraminidase__InfluenzaB__AEQ49685
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcuggccuucucuggcgugauggucagcaugaaggagccugggugguacuccuuuggcuucgaaaucaaagacaagaaaugcgauguuccguguauuggaaucgagauggugcacgacggcgggaaggaaacauggcauagcgcugccaccgccauuuauugccucaugggaucuggccagcugcuuugggauacagugacgggggucgacauggaucuguga

SEQ ID NO: 211918 - RNA, 1401 nt, Artificial Sequence
  derived and/or modified sequence opt5 from neuraminidase__InfluenzaB__AEQ49686
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuucugaaaauuagagaggggcggaucaucaaggagauuuucccgaccggacgcgugaagcacaccgaagaguguacaugcggcuuugccagcaacaaaacgaucgaaugugcuugcagagauaauuccuacaccgccaagcggccuuucguuaaacuuaacguggagacagacaccgccgaaauucgccugaugugcacagauaccuaucucgacacgcccagaccugaugacgggagcaucacaggacccugugagucuaauggcgacaagggguccggaggcauuaaaggcggguuuguccaucaacggauggagagcaagaucggacgcugguacucuagaaccaugagcaaaaccgaacggaugggcauggggcuguaugugaaguacgauggagaccccugggcugauuccgacgcgcuggccuucucuggcgugauggucagcaugaaggagccugggugguacuccuuuggcuucgaaaucaaagauaagaaaugcgacguuccguguauuggaaucgagauggugcacgauggcgggaaggaaacauggcauagcgcugccaccgccauuuauugccucaugggaucuggccagcugcuuugggacacagugacgggggucgauauggcucuguga

SEQ ID NO: 211919 - RNA, 1401 nt, Artificial Sequence
  derived and/or modified sequence opt5 from neuraminidase__InfluenzaB__AEQ49687
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaacauggcauagcgcugccaccgccauuuauugccucaugggaucuggccagcugcuuugggacacagugacgggggucgauauggcucuguga

SEQ ID NO: 211920 - RNA, 1401 nt, Artificial Sequence
  derived and/or modified sequence opt5 from neuraminidase__InfluenzaB__AEQ49688
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucggaugcgccaacgcgucuaauguucaagcugugaaccggagcgccacaaaaggcgugacccugcuucugcccgaaccugaguggacauauccccgccucuccuguccugggagcaccuuccagaaggcccugcuuaucucuccccacagauuuggagaaacgaaaggcaauuccgcuccucugauuauccgggagccguucaucgccugcgggcccaaggaauguaaacauuuugcucucacccacuacgccgcgcagccuggaggcuauuacaacggcacacgcgaggauagaaauaagcugcggcaucugauuagcgucaagcucgggaaaauccccaccguggagaacucuauuuuccacauggccgcuugguccggaagcgccugccaugacggccgcgaauggacauauaucgggguugauggaccugacucuaaugcucugcuuaagauuaaauacggcgaggccuacaccgauacguaucacuccuacgcgaagaacauccugagaacacaggaaagcgccuguaauugcauugggggagacuguuaucucaugaucaccgauggccccgcuuccggcaucucugagugccgguuucugaaaauucgcgaggggagaaucauuaaggaaaucuucccgacaggacgggugaagcacaccgaggaauguaccugcggcuuugccagcaacaaaacaauugagugugcuugccgcgacaauuccuacacggccaagagaccuuucgucaaacuuaacguggaaaccgauacagccgagauccggcugaugugcaccgagacauaucucgacacgccccgcccuaaugaugggagcaucaccggacccugugaaucuaacggcgacaagggguccggaggcauuaaaggcggguuuguucaucaaagaauggcuagcaagaucggacggugguacucuagaacaaugagcaaaaccaagcgcaugggcauggggcuguaugugaaguacgauggagaccccuggaccgacuccgaggcgcuggcccucucuggcgucauggugagcauggaggaaccugggugguacuccuucggcuuugaaauuaaagauaagaaaugcgacgugccguguaucggaauugagaugguccacgauggcgggaagacaaccuggcauagcgcugccacagccaucuauugccugaugggaucuggccagcuucugugggacacgguuaccggggugaauaugacacucuga

SEQ ID NO: 211921 - RNA, 1401 nt, Artificial Sequence
  derived and/or modified sequence opt5 from neuraminidase__InfluenzaB__AEQ49691
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgaccggggguccggaggcauuaagggcggguucguccaucaacgcauggagagcaaaaucggaagaugguacucucggaccaugagcaagaccgaaagaaugggcauggggcuguaugugaaauacgauggagaccccugggcugauuccgacgcgcuggccuuuucuggcgugauggucagcaugaaggagcccgggugguacuccuucggcuucgaaaucaaggauaaaaagugcgacguuccuuguauuggaaucgagauggugcacgauggcgggaaagaaacauggcauagcgcugccaccgccauuuauugccucaugggaucuggccagcugcuuugggacacagugacgggggucgauauggcucuguga

SEQ ID NO: 211922 - RNA, 1401 nt, Artificial Sequence
  derived and/or modified sequence opt5 from neuraminidase__InfluenzaB__AEQ49692
augcugcccagcaccauccagacacucacgcuguuccuuaccuccggcggggugcugcucucucuguacgucagcgccucccuuucuuaucugcucuacagcgacauucugcugaaguuuuccccuacagagaccacagcuccgaccaugucucucgauugcgccaacgcgagcaauguucaagcugugaacagauccgccacaaaaggagugaccuuccugcuucccgaaccugaguggacguauccccggcugagcuguccuggcucuaccuuucagaaggcccuccugaucagcccccaccgcuucggggaaacaaaaggaaauuccgcuccucuuauuaucagagagccguuuauugccugcggccccaacgaauguaagcauuucgcucugacccacuacgccgcgcagccugggggauauuacaauggcacacggggcgaccgcaacaaacucagacaucugaucucugucaagcuggggaagauccccaccguggaaaauuccauuuuucacauggccgcuuggagcggaucugccugccaugauggcaaagaguggacguauaucgggguugacggaccugauaacgacgcucuccugaaggugaaauacggcgaggccuacacagauaccuaucacuccuacgcgaauaagauucuucggacacaggagagcgccuguaacugcaucgggggaaauuguuaucugaugauuaccgacggcuccgcuucuggcgucagcgaaugccgcuuccucaaaaucagagaggggcggauuaucaaggagaucuuucccaccggacgcgugaagcacacagaagaguguacgugcggcuucgccuccaacaaaaccauugaaugugcuugcagagauaauagcuacacagccaagcggccguuuguuaaacugaacguggagaccgacacagccgaaauccgccuuaugugcaccgauacguaucuggacacaccuagacccgaugacgggucuauuaccggaccuugugaguccaauggcgacaaggggagcggaggcaucaaaggcggguucguccaucaacggauggagucuaagauuggacgcugguacagcagaaccauguccaaaacagaacggaugggcauggggcucuaugugaaguacgauggagaccccugggcugauucugacgcgcuggccuuuagcggcgugauggucuccaugaaggagcccgggugguacagcuucggcuucgaaaucaaagauaagaaaugcgacguuccuuguaucggaauugagauggugcacgauggcgggaaggaaaccuggcauucugcugccacagccaucuauugccugaugggauccggccagcuccugugggacacggugaccggggucgauauggcucuuuga

SEQ ID NO: 211923 - RNA, 1401 nt, Artificial Sequence
  derived and/or modified sequence opt5 from neuraminidase__InfluenzaB__AEQ49693
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauagaacgaucgaaugugcuugccgggacaacuccuacaccgccaaacgcccuuucguuaaacuuaauguggagacagauaccgccgaaauuagacugaugugcacagacaccuaucucgauacgccccggccuaacgacgggagcaucacaggacccugugagucugauggcgacaagggguccggaggcauuaagggcggguuuguccaucaacgcauggagagcaaaaucggaagaugguacucucggaccaugagcaagaccgaaagaaugggcauggggcuguaugugaaauacgacggagaucccugggcugacuccgaugcgcuggccuucucuggcgugauggucagcaugaaggagccugggugguacuccuuuggcuucgaaaucaaggacaaaaagugcgauguuccguguauuggaaucgagauggugcacgacggcgggaaagaaacauggcauagcgcugccaccgccauuuauugccucaugggaucuggccagcugcuuugggauacagugacgggggucgacauggcucuguga

SEQ ID NO: 211924 - RNA, 1401 nt, Artificial Sequence
  derived and/or modified sequence opt5 from neuraminidase__InfluenzaB__AEQ49695
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcuggccuucucuggcgugauggucagcaugaaggagccugggugguacuccuuuggcuucgaaaucaaagacaagaaaugcgauguuccguguauuggaaucgagauggugcacgacggcgggaaggaaacauggcauagcgcugccaccgccauuuauugccucaugggaucuggccagcugcuuugggauacagugacgggggucgacauggcucuguga

SEQ ID NO: 211925 - RNA, 1401 nt, Artificial Sequence
  derived and/or modified sequence opt5 from neuraminidase__InfluenzaB__AEQ49697
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggagugacauuccugcuucccgaaccugaguggaccuauccccggcugagcuguccuggcucuacguuucagaaggcccuccugauuagcccccaccgcuucggggaaaccaaaggaaauuccgcuccucuuaucauuagagagccguuuaucgccugcggccccaacgaauguaagcauuucgcucugacacacuacgccgcgcagccugggggauauuacaauggcacccggggcgaccgcaacaaacucagacaucugaucucugucaagcuggggaagauucccacaguggaaaauuccaucuuucacauggccgcuuggagcggaucugccugccaugauggcaaagaguggaccuauauugggguugacggaccugauaacgacgcucuccugaaggugaaauacggcgaggccuacacggauacauaucacuccuacgcgaauaagauccuucggacccaggagagcgccuguaacugcauugggggaaauuguuaucugaugaucacagacggcuccgcuucuggcgucagcgaaugccgcuuccucaaaauuagagaggggcggaucaucaaggagauuuuucccaccggacgcgugaagcacaccgaagaguguacaugcggcuucgccuccaacaaaacgaucgaaugugcuugcagagauaauagcuacaccgccaagcggccguuuguuaaacugaacguggagacagacaccgccgaaauucgccuuaugugcacagauaccuaucuggacacgccuagacccgaugacgggucuaucacaggaccuugugaguccaauggcgacaaggggagcggaggcauuaaaggcggguucguccaucaacggauggagucuaagaucggacgcugguacagcagaaccauguccaaaaccgaacggaugggcauggggcucuaugugaaguacgauggagaccccugggcugauucugacgcgcuggccuuuagcggcgugauggucuccaugaaggagcccgggugguacagcuucggcuucgaaaucaaagauaagaaaugcgacguuccuuguauuggaaucgagauggugcacgauggcgggaaggaaacauggcauucugcugccaccgccauuuauugccugaugggauccggccagcuccugugggacacagugacgggggucgauauggcucuuuga

SEQ ID NO: 211926 - RNA, 1401 nt, Artificial Sequence; identical to SEQ ID NO: 211925
  derived and/or modified sequence opt5 from neuraminidase__InfluenzaB__AEQ49698

SEQ ID NO: 211927 - RNA, 1401 nt, Artificial Sequence; identical to SEQ ID NO: 211925
  derived and/or modified sequence opt5 from neuraminidase__InfluenzaB__AEQ49699

SEQ ID NO: 211928 - RNA, 1401 nt, Artificial Sequence; identical to SEQ ID NO: 211925
  derived and/or modified sequence opt5 from neuraminidase__InfluenzaB__AEQ49700

SEQ ID NO: 211929 - RNA, 1401 nt, Artificial Sequence; identical to SEQ ID NO: 211922
  derived and/or modified sequence opt5 from neuraminidase__InfluenzaB__AEQ49701

SEQ ID NO: 211930 - RNA, 1401 nt, Artificial Sequence; identical to SEQ ID NO: 211925
  derived and/or modified sequence opt5 from neuraminidase__InfluenzaB__AEQ49702

SEQ ID NO: 211931 - RNA, 1401 nt, Artificial Sequence; identical to SEQ ID NO: 211922
  derived and/or modified sequence opt5 from neuraminidase__InfluenzaB__AEQ49703

SEQ ID NO: 211932 - RNA, 1401 nt, Artificial Sequence; identical to SEQ ID NO: 211925
  derived and/or modified sequence opt5 from neuraminidase__InfluenzaB__AEQ49705

SEQ ID NO: 211933 - RNA, 1401 nt, Artificial Sequence
  derived and/or modified sequence opt5 from neuraminidase__InfluenzaB__AEQ49706
augcugcccagcaccauccagaugcucacacuguuccuuacgcugggcggggugcuccugucccuuuacgucucugccagccuguccuaucuccuguaccuggacauucuccugaaguuuccuccgaccgagaucacagcucccaccaugccucuugauugcgccaacgcgucuaauguucaagcugugaacagaagcgccacaaaaggagugaccuuccugcuccccgaaccugaguggacauauccccggcuguccuguccuggcucuaccuuucagaaggcccuucugauuagcccgcaccgcuucggggaaacgaaaggaaauuccgcuccccucaucauuagagagccuuuuaucgccugcggccccaaggaauguaaacauuucgcucugacccacuacgccgcgcagccugggggauauuacaacggcacacggggcgaccgcaauaagcugagacaucucaucagcgucaagcuggggaaaauucccaccguggagaacucuaucuuucacauggccgcuugguccggaagcgccugccaugauggcaaggaguggacauauauugggguugacggaccggauaauaacgcucugcuuaaaaucaaguacggcgaagccuucaccgacacguaccacucuuaugcgaauaacauucuccggacacaggaguccgccuguaauugcaucgggggaaacuguuaccugaugauuaccgauggcagcgcuucuggcguguccgaaugccgcuuucuuaaaaucagagaggggcggaucauuaaggagaucuucccuacaggacgcgucaagcacaccgaagaguguaccugcggcuuugccagcaauaaaacaauugaaugugcuugcagagacaacuccuauacggccaagcggcccuucgugaaacugaauguugagaccgauacagccgaaauccgccucaugugcaccgacacauaccuggauaccccuagacccgacgaugggucuauuacgggacccugugagagcaacggcgacaagggguccggaggcaucaaaggcggguuugugcaucaacggauggcuagcaagaucggacgcugguauucuagaacaauguccaaaaccgagcggaugggcauggggcuguacgucaaguaugacggagauccuugggcggacagcgaugcccucgcuuucucuggcgugauggugagcaugaaggaaccggggugguacuccuucggcuuugagauuaaagacaagaaaugcgauguccccuguaucggaauugaaaugguucacgacggcgggaaggagaccuggcauucugccgccacagcuaucuacugccugaugggaagcggccagcuucugugggauaccgugacaggggugaacauggcccucuga

SEQ ID NO: 211934 - RNA, 1401 nt, Artificial Sequence; identical to SEQ ID NO: 211925
  derived and/or modified sequence opt5 from neuraminidase__InfluenzaB__AEQ49707

SEQ ID NO: 211935 - RNA, 1401 nt, Artificial Sequence; identical to SEQ ID NO: 211925
  derived and/or modified sequence opt5 from neuraminidase__InfluenzaB__AEQ49708

SEQ ID NO: 211936 - RNA, 1401 nt, Artificial Sequence
  derived and/or modified sequence opt5 from neuraminidase__InfluenzaB__AEQ49709
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcacuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaacauggcauagcgcugccaccgccauuuauugccucaugggaucuggccaucugcuuugggacacagugacgggggucgauauggcucuguga

SEQ ID NO: 211937 - RNA, 1401 nt, Artificial Sequence; identical to SEQ ID NO: 211899
  derived and/or modified sequence opt5 from neuraminidase__InfluenzaB__AEQ49710

SEQ ID NO: 211938 - RNA, 1401 nt, Artificial Sequence; identical to SEQ ID NO: 211896
  derived and/or modified sequence opt5 from neuraminidase__InfluenzaB__AER27042

SEQ ID NO: 211939 - RNA, 1401 nt, Artificial Sequence; identical to SEQ ID NO: 211924
  derived and/or modified sequence opt5 from neuraminidase__InfluenzaB__AER27053

SEQ ID NO: 211940 - RNA, 1401 nt, Artificial Sequence; identical to SEQ ID NO: 211896
  derived and/or modified sequence opt5 from neuraminidase__InfluenzaB__AER27064

SEQ ID NO: 211941 - RNA, 1401 nt, Artificial Sequence; identical to SEQ ID NO: 211899
  derived and/or modified sequence opt5 from neuraminidase__InfluenzaB__AET43128

SEQ ID NO: 211942 - RNA, 1401 nt, Artificial Sequence; identical to SEQ ID NO: 211899
  derived and/or modified sequence opt5 from neuraminidase__InfluenzaB__AET43139

SEQ ID NO: 211943 - RNA, 1401 nt, Artificial Sequence
  derived and/or modified sequence opt5 from neuraminidase__InfluenzaB__AET43150
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacccgaguggacauauccuagacucuccugucccggcagcaccuuccagaaagcccugcuuauuucuccucaucgguuuggggaaacgaagggaaauuccgcuccgcugaucauucgcgagcccuucaucgccugcggcccuaacgaauguaaacacuuugcucucacccauuacgccgcgcagcccgggggauauuacaauggcacaagaggcgaccggaacaagcugcgccaccugaucagcgucaagcucgggaaaauuccuaccguggaaaauucuaucuuccauauggccgcuugguccggaagcgccugccacgauggcaaggaguggacauauauugggguugacggacccgauaacaaugcucugcuuaaagugaaguacggcgaggccuacaccgacacguaucacucuuacgcgaacaaaauccugagaacacaggaguccgccuguaauugcauugggggaaacuguuaucucaugaucaccgauggcagcgcuuccggcgucucugaaugccgguuucugaagauucgcgaggggagaaucaucaaggagauuuucccgacaggacgggugaaacauaccgaagaguguaccugcggcuuugccagcaauaagacaaucgaaugugcuugccgcgacaacuccuacacggccaaaagaccuuucguuaaacuuaauguggagaccgauacagccgaaauucggcugaugugcaccgacacauaucucgauacgccccgcccugacgaugggagcaucaccggacccugugagucuaacggcgacaagggguccggaggcauuaagggcggguuuguccaccaaagaauggagagcaaaaucggacggugguacucucgcacaaugagcaagaccgaaagaaugggcauggggcuguaugugaaguacgacggagaucccugggcugacuccgaugcgcugaccuucucuggcgugauggucagcaugaaagagccugggugguacuccuuuggcuucgaaaucaaggacaaaaagugcgauguuccguguauuggaaucgagauggugcaugacggcgggaaagaaacauggcacagcgccgcuaccgccauuuauugccucaugggaucuggccagcugcuuugggauacagugacgggggucgacauggcccuguga

SEQ ID NO: 211944 - RNA, 1401 nt, Artificial Sequence; identical to SEQ ID NO: 211899
  derived and/or modified sequence opt5 from neuraminidase__InfluenzaB__AET43161

SEQ ID NO: 211945 - RNA, 1401 nt, Artificial Sequence; identical to SEQ ID NO: 211899
  derived and/or modified sequence opt5 from neuraminidase__InfluenzaB__AET43172

SEQ ID NO: 211946 - RNA, 1401 nt, Artificial Sequence; identical to SEQ ID NO: 211899
  derived and/or modified sequence opt5 from neuraminidase__InfluenzaB__AET43183

SEQ ID NO: 211947 - RNA, 1401 nt, Artificial Sequence; identical to SEQ ID NO: 211899
  derived and/or modified sequence opt5 from neuraminidase__InfluenzaB__AET43194

SEQ ID NO: 211948 - RNA, 1401 nt, Artificial Sequence; identical to SEQ ID NO: 211899
  derived and/or modified sequence opt5 from neuraminidase__InfluenzaB__AET43216

SEQ ID NO: 211949 - RNA, 1401 nt, Artificial Sequence; identical to SEQ ID NO: 211899
  derived and/or modified sequence opt5 from neuraminidase__InfluenzaB__AET43227

SEQ ID NO: 211950 - RNA, 1401 nt, Artificial Sequence
  derived and/or modified sequence opt5 from neuraminidase__InfluenzaB__AET50947
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacccgaguggacauauccuagacucuccugucccggcagcaccuuccagaaagcccugcuuauuucuccucaucgguuuggggaaacgaagggaaauuccgcuccgcugaucauucgcgagcccuucaucgccugcggcccuaacgaauguaaacacuuugcucucacccauuacgccgcgcagcccgggggauauuacaauggcacaagaggcgaccggaacaagcugcgccaccugaucagcgucaagcucgggaaaauuccuaccguggaaaauucuaucuuccauauggccgcuugguccggaagcgccugccacgauggcaaggaguggacauauauugggguugacggacccgauaacaaugcucugcuuaaagugaaguacggcgaggccuacaccgacacguaucacucuuacgcgaacaaaauccugagaacacaggaguccgccuguaauugcauugggggaaacuguuaucucaugaucaccgauggcagcgcuuccggcgucucugaaugccgguuucugaagauucgcgaggggagaaucaucaaggagauuuucccgacaggacgggugaaacauaccgaagaguguaccugcggcuuugccagcaauaagacaaucgaaugugcuugccgcgacaacuccuacacggccaaaagaccuuucguuaaacuuaauguggagaccgauacagccgaaauucggcugaugugcaccgacacauaucucgauacgccccgcccugacgaugggagcaucaccggacccugugagucuaacggcgacaagggguccggaggcauuaagggcggguuuguccaccaaagaauggagagcaaaaucggacggugguacucucgcacaaugagcaagaccgaaagaaugggcauggggcuguaugugaaguacgacggagaucccugggcugacuccgaugcgcuggccuucucuggcgugaugaucagcaugaaagagccugggugguacuccuuuggcuucgaaauuaaggacaaaaagugcgaugucccguguaucggaauugagaugguucaugacggcgggaaagaaaccuggcacagcgcugccacagccaucuauugccucaugggaucuggccagcugcuuugggauaccgugacagggguggacauggcucuguga

SEQ ID NO: 211951 - RNA, 1401 nt, Artificial Sequence
  derived and/or modified sequence opt5 from neuraminidase__InfluenzaB__AET50958
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacucgaguggacauaucccagacuguccuguccuggcagcaccuuccagaaagcccuucugauuucuccccaucgguuuggggaaacgaagggaaauuccgcuccucucaucauucgcgagccguucaucgccugcggccccaacgaauguaaacacuuugcucugacccauuacgccgcgcagccugggggauauuacaauggcacaagaggcgaccggaacaagcugcgccaccucaucagcgucaagcuggggaaaauucccaccguggaaaauucuaucuuccauauggccgcuugguccggaagcgccugccacgauggcaaggaguggacauauauugggguugacggaccugauaacaaugcccuucugaaagugaaguacggcgaggcuuacaccgacacguaucacucuuacgcgaacaaaauccucagaacacaggaguccgccuguaauugcauugggggaaacuguuaucugaugaucaccgauggcagcgcuuccggcgucucugaaugccgguuucuuaagauucgcgaggggagaaucaucaaggagauuuuccccacaggacgggugaaacauaccgaagaguguaccugcggcuuugccagcaauaagacaaucgaaugugcuugccgcgacaacuccuacacggccaaaagaccguucguuaagcugaauguggagaccgauacagccgaaauucggcucaugugcaccgacacauaucuggauaccccucgccccgacgaugggagcaucacgggaccuugugagucuaacggcgacaaaggguccggaggcauuaagggcggguuuguccaccaaagaauggagagcaaaaucggacggugguacucucgcacaaugagcaagaccgaaagaaugggcauggggcuguaugugaaguacgacggagaucccugggcugacuccgaugcgcucgccuucucuggcgugauggucagcaugaaagagcccgggugguacuccuuuggcuucgaaaucaaggacaaaaagugcgauguuccuuguauuggaaucgagauggugcaugacggcgggaaagaaaccuggcacagcgcugccacagccauuuauugccugaugggaucuggccagcuucugugggauaccgugacaggggucgacauggcucucuga

SEQ ID NO: 211952 - RNA, 1401 nt, Artificial Sequence; identical to SEQ ID NO: 211899
  derived and/or modified sequence opt5 from neuraminidase__InfluenzaB__AET50969

SEQ ID NO: 211953 - RNA, 1401 nt, Artificial Sequence; identical to SEQ ID NO: 211899
  derived and/or modified sequence opt5 from neuraminidase__InfluenzaB__AET50980

SEQ ID NO: 211954 - RNA, 1401 nt, Artificial Sequence; identical to SEQ ID NO: 211899
  derived and/or modified sequence opt5 from neuraminidase__InfluenzaB__AET74259

SEQ ID NO: 211955 - RNA, 1401 nt, Artificial Sequence; identical to SEQ ID NO: 211899
  derived and/or modified sequence opt5 from neuraminidase__InfluenzaB__AET74270

SEQ ID NO: 211956 - RNA, 1401 nt, Artificial Sequence; identical to SEQ ID NO: 211950
  derived and/or modified sequence opt5 from neuraminidase__InfluenzaB__AET74281

SEQ ID NO: 211957 - RNA, 1401 nt, Artificial Sequence; identical to SEQ ID NO: 211899
  derived and/or modified sequence opt5 from neuraminidase__InfluenzaB__AET74292

SEQ ID NO: 211958 - RNA, 1401 nt, Artificial Sequence; identical to SEQ ID NO: 211899
  derived and/or modified sequence opt5 from neuraminidase__InfluenzaB__AET74303

SEQ ID NO: 211959 - RNA, 1401 nt, Artificial Sequence; identical to SEQ ID NO: 211899
  derived and/or modified sequence opt5 from neuraminidase__InfluenzaB__AET74314

SEQ ID NO: 211960 - RNA, 1401 nt, Artificial Sequence; identical to SEQ ID NO: 211899
  derived and/or modified sequence opt5 from neuraminidase__InfluenzaB__AET74333

SEQ ID NO: 211961 - RNA, 1401 nt, Artificial Sequence
  derived and/or modified sequence opt5 from neuraminidase__InfluenzaB__AET74344
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacccgaguggacauauccuagacucuccugucccggcagcaccuuccagaaagcccugcuuauuucuccucaucgguuuggggaaacgaagggaaauuccgcuccgcugaucauucgcgagcccuucaucgccugcggcccuaacgaauguaaacacuuugcucucacccauuacgccgcgcagcccgggggauauuacaauggcacaagaggcgaccggaacaagcugcgccaccugaucagcgucaagcucgggaaaauuccuaccguggaaaauucuaucuuccauauggccgcuugguccggaagcgccugccacgauggcaaggaguggacauauauugggguugacggacccgauaacaaugcucugcuuaaagugaaguacggcgaggccuacaccgacacguaucacucuuacgcgaacaaaauccugagaacacaggaguccgccuguaauugcauugggggaaacuguuaucucaugaucaccgauggcagcgcuuccggcgucucugaaugccgguuucugaagauucgcgaggggagaaucaucaaggagauuuucccgacaggacgggugaaacauaccgaagaguguaccugcggcuuugccagcaauaagacaaucgaaugugcuugccgcgacaacuccuacacggccaaaagaccuuucguuaaacuuaauguggaggccgauaccgcugaaauucggcugaugugcacagacaccuaucucgauacaccccgcccugacgaugggagcaucaccggacccugugagucuaacggcgacaagggguccggaggcauuaagggcggguuuguccaccaaagaauggagagcaaaaucggacggugguacucucgcacgaugagcaagacagaaagaaugggcauggggcuguaugugaaguacgacggagaucccugggcggacuccgaugcccuggcuuucucuggcgugauggucagcaugaaagagccugggugguacuccuuuggcuucgaaaucaaggacaaaaagugcgauguuccguguauuggaaucgagauggugcaugacggcgggaaagaaaccuggcacagcgccgccaccgcuauuuauugccucaugggaucuggccagcugcuuugggauacagugaccggggucgacauggcccuguga

SEQ ID NO: 211962 - RNA, 1401 nt, Artificial Sequence; identical to SEQ ID NO: 211899
  derived and/or modified sequence opt5 from neuraminidase__InfluenzaB__AET74355

SEQ ID NO: 211963 - RNA, 1404 nt, Artificial Sequence
  derived and/or modified sequence opt5 from neuraminidase__InfluenzaB__AEY75594
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuucugccugaacccgaguggacauauccucggcucuccugucccggcagcaccuuucaaaaggcccugcuuauuucuccucaucgcuucggggaaacgaaaggaaauuccgcuccgcugaucauuagagagcccuuuaucgccugcggcccuaacgaauguaagcacuucgcucucacccauuacgccgcgcagcccgggggauauuacaauggcacacggggcgaccgcaacaaacugagacaccugaucagcgucaagcucgggaagauuccuaccguggaaaauucuaucuuucauauggccgcuugguccggaagcgccugccacgauggcaaagaguggacauauauugggguugacggacccgauaacaaugcucugcuuaagaucaaauacggcgaggccuacaccgacacguaucacucuuacgcgaacaauauucugcggacacaggaguccgccuguaacugcaucgggggaaauuguuaucucaugauuaccgauggcagcgcuuccggcgugucugaaugccgcuuccugaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaaacuuaacguugagaccgauacagccgaaauccgccugaugugcaccgacacauaucucgauacccccagaccugacgaugggagcauuacgggacccugugagucuaacggcgacaagggguccggaggcacaaagggcggguucgugcaccagcggauggcuagcaaaaucggacgcugguacucuagaaccaugagcaagaccgagcggaaaggcauggggcuguaugucaaguacgacggagaucccuggacagacuccgaugcgcuggccuuuagaggcgugauggugucuaugaaggaaccugggugguacagcuucggcuucgagaucaaagacaagaaaugcgaugucccguguauuggaaucgaaaugguucaugacggcgggaaggagaccuggcacuccgcugccacagccauuuauugccucaugggaagcggccaacugcuuugggauacggugaccgggguggacauggcucuguga

SEQ ID NO: 211964 - RNA, 1401 nt, Artificial Sequence
  derived and/or modified sequence opt5 from neuraminidase__InfluenzaB__AFA45223
augcugcccagcaccauccagacacucacgcuguuccuuaccuccggcggggugcugcucucucuguacgucagcgcccuucuguccuaucuccuguacucugacauucugccuaaguuuagcccgacagagaucaccgcucccacaaugucccucgauugcgccaacgcgucuaauguucaagcugugaacagaagcgccaccaaaggagugacauuccugcuuuccgaaccugaguggaccuauccccggcugagcuguccuggcucuacguuucagaaggcccuccugauuagcccccaccgcuucggggaaaccaaaggaaauuccgcuccucuuaucauuagagagccguuuaucgccugcggccccaacgaauguaagcauuucgcucugacacacuacgccgcgcagccugggggauauuacaauggcacccggggcgaccgcaacaaacucagacaucugaucucugucaagcuggggaagauucccacaguggaaaauuccaucuuucacauggccgcuuggagcggaucugccugccaugauggcaaagaguggaccuauauugggguugacggaccugauaacgacgcucuccugaaggugaaauacggcgaggccuacacggauacauaucacuccuacgcgaauaagauccuucggacccaggagagcgccuguaacugcauugggggaaauuguuaucugaugaucacagacggcuccgcuucuggcgucagcgaaugccgcuuccucaaaauuagagaggggcggaucaucaaggagauuuuucccaccggacgcgugaagcacaccgaagaguguacaugcggcuucgccuccaacaaaacgaucgaaugugcuugcagagauaauagcuacaccgccaagcggccguuuguuaaacugaacguggagacagacaccgccgaaauucgccuuaugugcacagauaccuaucuggacacgccuagacccgaugacgggucuaucacaggaccuugugaguccaauggcgacaaggggagcggaggcauuaaaggcggguucguccaucaacggauggagucuaagaucggacgcugguacagcagaaccauguccaaaaccgaacggaugggcauggggcucuaugugaaguacgauggagaccccugggcugauucugacgcgcuggccuuuagcggcgugauggucuccaugaaggagcccgggugguacagcuucggcuucgaaaucaaagauaagaaaugcgacguuccuuguauuggaaucgagauggugcacgauggcgggaaggaaacauggcauucugcugccaccgccauuuauugccugaugggauccggccagcuccugugggacacagugacgggggucgauauggcucuuuga

SEQ ID NO: 211965 - RNA, 1401 nt, Artificial Sequence
  derived and/or modified sequence opt5 from neuraminidase__InfluenzaB__AFA45226
augcugcccagcaccauccagacacucacgcuguuccuuaccuccggcggggugcugcucucucuguacgucagcgccucccuuucuuaucugcucuacagcgacauucugcugaaguuuuccccuacagagaccacagcuccgaccaugucucucgauugcgccaacgcgagcaauguucaagcugugaacagauccgccacaaaaggagugaccuuccugcuucccgaaccugaguggacguauccccggcugagcuguccuggcucuaccuuucagaaggcccuccugaucagcccccaccgcuucggggaaacaaaaggaaauuccgcuccucuuauuaucagagagccguuuauugccugcggccccaacgaauguaagcauuucgcucugacccacuacgccgcgcagccugggggauauuacaauggcacacggggcgaccgcaacaaacucagacaucugaucucugucaagcuggggaaggugcccaccguugaaaauuccaucuuucacauggccgcuuggagcggaucugccugccaugauggcaaagaguggacguauauugggguggacggaccugauaacgacgcucuccugaaggucaaauacggcgaggccuacacagauaccuaucacuccuacgcgaauaagauccuucggacacaggagagcgccuguaacugcauugggggaaauuguuaucugaugaucaccgacggcuccgcuucuggcgugagcgaaugccgcuuccucaaaauuagagaggggcggaucauuaaggagaucuuucccaccggacgcguuaagcacacagaagaguguacgugcggcuucgccuccaacaaaaccaucgaaugugcuugcagagauaauagcuacacagccaagcggccguuugugaaacugaacgucgagaccgacacagccgaaauucgccuuaugugcaccgauacguaucuggacacaccuagacccgaugacgggucuaucaccggaccuugugaguccaauggcgacaaggggagcggaggcauuaaaggcggguucgugcaucaacggauggagucuaagaucggacgcugguacagcagaaccauguccaaaacagaacggaugggcauggggcucuaugugaaguacgauggagaccccugggcugauucugacgcgcuggccuuuagcggcgucaugguuuccaugaaggagcccgggugguacagcuucggcuucgaaauuaaagauaagaaaugcgacgugccuuguaucggaaucgagauggugcacgauggcgggaagggaaccuggcauucugcugccacagccauuuauugccugaugggcuccgggcagcuccugugggacacggucaccggaguggauauggcucuuuga

SEQ ID NO: 211966 - RNA, 1401 nt, Artificial Sequence
  derived and/or modified sequence opt5 from neuraminidase__InfluenzaB__AFA45229
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugccccuggauugcgccaacgcguccaauguucaagcugugaacagaucugccaccaaaggagugacauuccuucugccugaacccgaguggaccuauccucggcucagcugucccggcuccacguuucagaaggcccugcuuauuagcccucaccgcuucggggaaaccaaaggaaauucugcuccgcugaucauuagagagcccuuuaucgccugcggcccuaacgaauguaagcauuucgcucucacacacuacgccgcgcagcccgggggauauuacaauggcacccggggcgaccgcaacaaacugagacaucugaucuccgucaagcucgggaagauuccuacaguggagaauagcaucuuucacauggccgcuuggucuggauccgccugccaugauggcaaagaguggaccuauauugggguugacggacccgauaacgacgcucugcuuaaggugaaauacggcgaagccuacacggauacauaucacagcuacgcgaauaagauccugcggacccaggagucugccuguaacugcauugggggaaauuguuaucucaugaucacagacggcuccgcuagcggcgucuccgaaugccgcuuccugaaaauuagagaggggcggaucaucaaggagauuuuuccgaccggacgcgugaagcacaccgaagaguguacaugcggcuucgccucuaacaaaacgaucgaaugugcuugcagagauaauagcuacaccgccaagcggccuuuuguuaaacuuaacguggagacagacaccgccgaaauucgccugaugugcacagauaccuaucucgacacgcccagaccugaugacggguccaucacaggacccugugagagcaauggcgacaaggggucuggaggcauuaaaggcggguucguccaucaacggauggaguccaagaucggacgcugguacagcagaaccaugucuaaaaccgaacggaugggcauggggcuguaugugaaguacgauggagaccccugggcugauagcgacgcgcuggccuuuuccggcgugauggucucuaugaaggagccugggugguacagcuucggcuucgaaaucaaagauaagaaaugcgacguuccguguauuggaaucgagauggugcacgauggcgggaaggaaacauggcauuccgcugccaccgccauuuauugccucaugggaagcggccagcugcuuugggacacagugacgggggucgauauggcucuguga

SEQ ID NO: 211967 - RNA, 1401 nt, Artificial Sequence; identical to SEQ ID NO: 211919
  derived and/or modified sequence opt5 from neuraminidase__InfluenzaB__AFA45235

SEQ ID NO: 211968 - RNA, 1401 nt, Artificial Sequence
  derived and/or modified sequence opt5 from neuraminidase__InfluenzaB__AFA45238
augcugcccagcaccauccagacacucacgcuguuccuuaccuccggcggggugcugcucucucuguacgucagcgccucccuuucuuaucugcucuacagcgacauucugcugaaguuuuccccuacaaaaaccacagcuccgaccaugucucucgauugcgccaacgcgagcaauguucaagcugugaacagauccgccacaaagggagugaccuuccugcuucccgagccugaauggacguauccccggcugagcuguccuggcucuaccuuucagaaagcccuccugaucagcccccaccgcuucggggagacaaagggaaauuccgcuccucuuauuaucagagaaccguuuauugccugcggccccaacgaguguaaacauuucgcucugacccacuacgccgcgcagccugggggauauuacaauggcacacggggcgaccgcaacaagcucagacaucugaucucugucaagcuggggaaaauccccaccguggaaaauuccauuuuucacauggccgcuuggagcggaucugccugccaugauggcaaggaguggacguauaucgggguugacggaccugauaacgacgcucuccugaaagugaaguacggcgaggccuacacagauaccuaucacuccuacgcgaauaaaauucuucggacacaggaaagcgccuguaacugcaucgggggaaauuguuaucugaugauuaccgacggcuccgcuucuggcgucagcgagugccgcuuccucaagaucagagaagggcggauuaucaaggagaucuuucccaccggacgcgugaaacacacagaggaauguacgugcggcuucgccuccaacaagaccauugagugugcuugcagagauaauagcuacacagccaaacggccguuuguuaagcugaacguggaaaccgacacagccgagauccgccuuaugugcaccgauacguaucuggacacaccuagacccgaugacgggucuauuaccggaccuugugaauccaauggcgacaaagggagcggaggcaucaagggcggguucguccaucaacggauggagucuaaaauuggacgcugguacagcagaaccauguccaagacagagcggaugggcauggggcucuaugugaaguacgauggagaccccugggcugauucugacgcgcuggccuuuagcggcgugauggucuccaugaaagaacccgggugguacagcuucggcuucgagaucaaggauaaaaagugcgacguuccuuguaucggaauugaaauggugcacgauggcgggaaagagaccuggcauucugcugccacagccaucuauugccugaugggauccggccagcuccugugggacacggugaccggggucgauauggcucuuuga

SEQ ID NO: 211969 - RNA, 1401 nt, Artificial Sequence
  derived and/or modified sequence opt5 from neuraminidase__InfluenzaB__AFA45241
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugauuuuccugcuuccugaacccgaguggacauauccucggcuguccugucccggcagcaccuuucagaaggcccuccugaucucuccucaccgcuucggggaaacgaaaggaaauuccgcuccgcuuauuaucagagagcccuuuaucgccugcggcccuaacgaauguaagcauuucgcucugacccacuacgccgcgcagcccgggggauauuacaauggcacacggggcgaccgcaacaaacucagacaucugauuagcgucaagcuggggaagaucccuaccguggaaaauucuauuuuucacauggccgcuugguccggaagcgccugccaugauggcaaagaguggacauauaucgggguugacggacccgauaacaaugcucuccugaaggugaaauacggcgaggccuacaccgacacguaucacucuuacgcgaacaagauucuucggacacaggaguccgccuguaauugcaucgggggaaacuguuaucugaugauuaccgauggcagcgcuuccggcgucucugaaugccgcuuccucaaaaucagagaggggcggaucauuaaggagaucuuuccgacaggacgcgugaagcacaccgaagaguguaccugcggcuucgccagcaauaaaacaauugaaugugcuugcagagacaacuccuacacggccaagcggccuuuuguuaaacugaauguggagaccgauacagccgaaauccgccuuaugugcaccgacacauaucuggauacccccagaccugacgaugggagcauuacgggacccugugagucuaacggcgacaagggguccggaggcaucaaaggcggguucguccaucaacggauggagagcaagaucggacgcugguacucuagaacaaugagcaaaaccgaacggaugggcauggggcucuaugugaaguacgacggagaucccugggcugacuccgaugcgcugaccuuuucuggcgugauggucagcaugaaggagccugggugguacuccuucggcuucgaaauuaaagacaagaaaugcgauguuccguguaucggaauugagauggugcacgacggcgggaaggaaacauggcauagcgccgcuaccgccaucuauugccugaugggaucuggccagcuccugugggauacagugacgggggucgacauggcccuuuga

SEQ ID NO: 211970 - RNA, 1401 nt, Artificial Sequence
  derived and/or modified sequence opt5 from neuraminidase__InfluenzaB__AFA45244
augcugcccagcaccauccagacacucacgcuguuccuuaccuccggcggggugcugcucucucuguacgucagcgccucccuuucuuaucugcucuacagcgacauucugcugaaguuuuccccuacagagaccacagcuccgaccaugucucucgauugcgccaacgcgagcaauguucaagcugugaacagauccgccacaaaaggagugaccuuccugcuucccgaaccugaguggacguauccccggcugagcuguccuggcucuaccuuucagaaggcccuccugaucagcccccaccgcuucggggaaacaaaaggaaauuccgcuccucuuauuaucagagagccguuuauugccugcggccccaacgaauguaagcauuucgcucugacccacuacgccgcgcagccugggggauauuacaauggcacacggggcgaccgcaacaaacucagacaucugaucucugucaagcuggggaagauccccaccguggaaaauuccauuuuucacauggccgcuuggagcggaucugccugccaugauggcaaagaguggacguauaucgggguugacggaccugauaacgacgcucuccugaaggugaaauacggcgaggccuacacagauaccuaucacuccuacgcgaauaagauucuucggacacaggagagcgccuguaacugcaucgggggaaauuguuaucugaugauuaccgacggcuccgcuucuggcgucagcgaaugccgcuuccucaaaaucagagaggggcggauuaucaaggagaucuuucccaccggacgcgugaagcacacagaagaguguacgugcggcuucgccuccaacaaaaccauugaaugugcuugcagagauaauagcuacacagccaagcggccguuuguuaaacugaacguggagaccgacacagccgaaauccgccuuaugugcaccgauacguaucuggacacaccuagacccgaugacgggucuauuaccggaccuugugaguccaauggcgacaaggggagcggaggcaucaaaggcggguucguccaucaacggauggagucuaagauuggacgcugguacagcagaaccauguccaaaacagaacggaugggcauggggcucuaugugaaguacgauggagaccccugggcugauucugacgcgcuggccuuuagcggcgugauggucuccaugaaggagcccgggugguacagcuucggcuucgaaaucaaagauaagaaaugcgacguuccuuguaucggaauugagauggugcacgauggcgggaagaaaaccuggcauucugcugccacagccaucuauugccugaugggauccggccagcuccugugggacacggugaccggggucgauauggcucuuuga

SEQ ID NO: 211971 - RNA, 1401 nt, Artificial Sequence
  derived and/or modified sequence opt5 from neuraminidase__InfluenzaB__AFA45247
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaacgaauguaagcauuuugcucucacccacuacgccgcgcagccugggggauauuacaauggcacacggggcgaccgcaacaaacugagacaucugaucagcgucaagcucgggaagauucccaccguggaaaauucuaucuuccacauggccgcuugguccggaagcgccugccaugauggcaaagaguggacguauauugggguugacggaccugauaacaaugcucugcuuaaggugaaauacggcgaggccuacacagacaccuaucacucuuacgcgaacaagauccugcggacacaggaguccgccuguaauugcauugggggaaacuguuaucucauggucaccgauggcagcgcuuccggcgugucugaaugccgcuuucugaaaaucagagaggggcggauuaucaaggagaucuuccccaccggacgcguuaagcacacagaagaguguacgugcggcuuugccagcaauaaaaccauugaaugugcuugcagagacaacuccuacacagccaagcggccguucgugaaacuuaaugucgagaccgauacagccgaaauccgccugaugugcaccgacacguaucucgauacaccuagacccgacgaugggagcauuaccggaccuugugagucuaacggcgacaagggguccggaggcaucaaaggcggguuugugcaucaacggauggagagcaagauuggacgcugguacucuagaaccaugagcaaaacagaacggaugggcauggggcuguaugugaaguacgacggagaucccugggcugacuccgaugcgcuggucuucucuggcguuauggugagcaugaaggagcccgggugguacuccuuuggcuucgaaaucaaagacaagaaaugcgaugugccuuguaucggaauugagaugguccacgacggcgggaaggaaaccuggcauagcgccgcuacagccaucuauugccucaugggaucuggccagcugcuuugggauacggugaccgggguugacauggcccuguga

SEQ ID NO: 211972 - RNA, 1401 nt, Artificial Sequence; identical to SEQ ID NO: 211922
  derived and/or modified sequence opt5 from neuraminidase__InfluenzaB__AFA45250

SEQ ID NO: 211973 - RNA, 1401 nt, Artificial Sequence
  derived and/or modified sequence opt5 from neuraminidase__InfluenzaB__AFA45253
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaauguguuugcagagauaauuccuacaccgcuaagcggccguuugugaaacuuaacgucgagacagacaccgccgaaauucgccugaugugcacagauaccuaucucgacacgccuagacccgaugacgggagcaucacaggaccuugugagucuaauggcgacaagggguccggaggcauuaaaggcggguucgugcaucaacggauggagagcaagaucggacgcugguacucuagaaccaugagcaaaaccgaacggaugggcauggggcuguaugugaaguacgauggagaccccugggccgauuccgacgcucuggcguuuucuggcgucaugguuagcaugaaggagcccgggugguacuccuucggcuucgaaaucaaagauaagaaaugcgacgugccuuguauuggaaucgagauggugcacgauggcgggaaggaaacauggcauagcgccgcuaccgccauuuauugccucaugggaucuggccagcugcuuugggacacagucacggggguggauauggcccuguga

SEQ ID NO: 211974 - RNA, 1401 nt, Artificial Sequence
  derived and/or modified sequence opt5 from neuraminidase__InfluenzaB__AFB77645
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcgugaagcacaccgaagaguguaccugcggcuuugcuagcaauaaaacaaucgaaugugccugcagagacaacuccuacacggccaagcggccuuucguuaaacuuaauguggagaccgauacagcugaaauucgccugaugugcaccgacacauaucucgauacccccagaccuaacgacgggagcaucacgggacccugugagucugauggcgacaagggguccggaggcauuaaaggcggguuuguccaucaacggauggagagcaagaucggacgcugguacucuagaacaaugagcaaaaccgaacggaugggcauggggcuguaugugaaguacgacggagaucccugggcggacuccgaugcccugguguucucuggcgucaugguuagcaugaaggagccugggugguacuccuuuggcuucgaaaucaaagacaagaaaugcgaugugccguguauuggaaucgagauggugcacgacggcgggaaggaaaccuggcauagcgcugccacagccauuuauugccucaugggaucuggccagcugcuuugggauaccgucacagggguggacauggcucuguga

SEQ ID NO: 211975 - RNA, 1401 nt, Artificial Sequence
  derived and/or modified sequence opt5 from neuraminidase__InfluenzaB__AFB77647
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccauuccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuaucucuccucaccgcuuuggggaaacgaaaggaaauuccgccccgcugauuaucagagagcccuucaucgcuugcggcccuaacgaauguaagcauuuugcccucacccacuacgcggcccagcccgggggauauuacaauggcacacggggcgaccgcaacaaacugagacaucugauuagcgucaagcucgggaagaucccuaccguggaaaauucuauuuuccacauggcugccugguccggaagcgcuugccaugauggcaaagaguggacauauaucgggguugacggacccgauaacaaugcccugcuuaaggugaaauacggcgaggcguacaccgacacguaucacucuuacgccaacaagauucugcggacacaggaguccgcuuguaauugcaucgggggaaacuguuaucucaugauuaccgauggcagcgccuccggcgucucugaaugccgcuuucugaaaaucagagaggggcggaucauuaaggagaucuucccgacaggacgcgugaagcacaccgaagaguguaccugcggcuuugcuagcaauaaaacaauugaaugugccugcagagacaacuccuacacggccaagcggccuuucguuaaacuuaauguggagaccgauacagcugaaauccgccugaugugcaccgacacauaucucgauacccccagaccuaacgacgggagcauuacgggacccugugagucugauggcgacaagggguccggaggcaucaaaggcggguuuguccaucaacggauggagagcaagaucggacgcugguacucuagaacaaugagcaaaaccgaacggaugggcauggggcuguaugugaaguacgacggagaucccugggcggacuccgaugcccuggcuuucucuggcgugauggucagcaugaaggagccugggugguacuccuuuggcuucgaaauuaaagacaagaaaugcgauguuccguguaucggaauugagauggugcacgacggcgggaaggaaaccuggcauagcgccgccacagcuaucuauugccucaugggaucuggccagcugcuuugggauaccgugacaggggucgacauggcccuguga

SEQ ID NO: 211976 - RNA, 1401 nt, Artificial Sequence
  derived and/or modified sequence opt5 from neuraminidase__InfluenzaB__AFB77649
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcaucaagcacaccgaagaguguaccugcggcuuugcuagcaauaaaacaauugaaugugccugcagagacaacuccuacacggccaagcggccuuucgugaaacuuaauguugagaccgauacagcugaaauccgccugaugugcaccgacacauaucucgauacccccagaccuaacgacgggagcauuacgggacccugugagucugauggcgacaagggguccggaggcaucaaaggcggguuugugcaucaacggauggagagcaagaucggacgcugguacucuagaacaaugagcaaaaccgaacggaugggcauggggcuguaugucaaguacgacggagaucccugggcggacuccgaugcccuggcuuucucuggcgugauggugagcaugaaggagccugggugguacuccuuuggcuucgaaauuaaagacaagaaaugcgaugucccguguaucggaauugagaugguucacgacggcgggaaggaaaccuggcauagcgccgccacagcuaucuauugccucaugggaucuggccagcugcuuugggauaccgugacagggguggacauggcccuguga

SEQ ID NO: 211977 - RNA, 1401 nt, Artificial Sequence
  derived and/or modified sequence opt5 from neuraminidase__InfluenzaB__AFB77651
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaccagcgucaagcucgggaagaucccuacaguggaaaauucuauuuuccacauggcugccugguccggaagcgcuugccaugauggcaaagaguggaccuauaucgggguugacggacccgauaacaaugcccugcuuaaggugaaauacggcgaggcguacacggacacauaucacucuuacgccaacaagauucugcggacccaggaguccgcuuguaauugcaucgggggaaacuguuaucucaugauuacagauggcagcgccuccggcgucucugaaugccgcuuucugaaaaucagagaggggcggauuaucaaggagaucuucccgaccggacgcgugaagcacaccgaagaguguacaugcggcuuugcuagcaauaaaacgauugaaugugccugcagagacaacuccuacaccgccaagcggccuuucguuaaacuuaauguggagacagauaccgcugaaauccgccugaugugcacagacaccuaucucgauacgcccagaccuaacgacgggagcauuacaggacccugugagucugauggcgacaagggguccggaggcaucaaaggcggguuuguccaucaacggauggagagcaagauuggacgcugguacucuagaaccaugagcaaaaccgaacggaugggcauggggcuguaugugaaguacgacggagaucccugggcggacuccgaugcccuggcuuucucuggcgugauggucagcaugaaggagccugggugguacuccuuuggcuucgaaaucaaagacaagaaaugcgauguuccguguaucggaauugagauggugcacgacggcgggaaggaaacauggcauagcgccgccaccgcuaucuauugccucaugggaucuggccagcugcuuugggauacagugacgggggucgacauggcccuguga

SEQ ID NO: 211978 - RNA, 1401 nt, Artificial Sequence
  derived and/or modified sequence opt5 from neuraminidase__InfluenzaB__AFE00364
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacagacuccggcaccugaucagcgucaaacuggggaagauuccuaccguggaaaauucuaucuuucauauggccgcuugguccggaagcgccugccacgauggcaaggaguggacauauauugggguugacggacccgauaacaaugcucuccugaaaaucaaguacggcgaggccuacaccgacacguaucacucuuacgcgaacaauauucuucgcacacaggaguccgccuguaacugcaucgggggaaauuguuaucugaugauuaccgauggcagcgcuuccggcgugucugaaugcagauuccucaaaauccgggaggggcgcaucauuaaggagaucuuuccgacaggaagagucaaacauaccgaagaguguaccugcggcuucgccagcaacaagacaauugaaugugcuugccgggacaauuccuacacggccaagcgcccuuuugugaaacugaacguugagaccgauacagccgaaaucagacuuaugugcaccgacacauaucuggauacgccccggccugacgaugggagcauuaccggacccugugagucuaacggcgacaagggguccggaggcaucaaaggcggguucgugcaccagcgcauggcuagcaagaucggaagaugguacucucggacaaugagcaaaaccgagagaaagggcauggggcucuaugucaaauacgacggagaucccuggaccgacuccgaugcgcuggccuuucgcggcgugauggugucuaugaaggaaccugggugguacagcuucggcuucgagauuaaggacaaaaagugcgaugucccguguaucggaauugaaaugguucaugacggcgggaaagagacauggcacuccgcugccaccgccaucuauugccugaugggaagcggccaacuccugugggauacagugacggggguggacauggcucuuuga

SEQ ID NO: 211979 - RNA, 1401 nt, Artificial Sequence
  derived and/or modified sequence opt5 from neuraminidase__InfluenzaB__AFF18536
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaaugucggcacuucgcucugacccauuacgccgcgcagcccgggggauauuacaauggcacacgcggcgacagaaacaagcuccggcaccugaucagcgucaaacuggggaagauuccuaccguggaaaauucuaucuuucauauggccgcuugguccggaagcgccugccacgauggcaaggaguggacauauauugggguugacggacccgauaacaaugcucuccugaaaaucaaguacggcgaggccuacaccgacacguaucacucuuacgcgaacaauauucuucgcacacaggaguccgccuguaacugcaucagagggaauuguuaucugaugauuaccgauggaagcgcuuccggcgugucugaaugccgguuccucaaaauccgcgagggcagaaucauuaaggagaucuuuccgacagggcgggucaaacauaccgaagaguguaccugcggauucgccagcaacaagacaauugaaugugcuugccgcgacaauuccuacacggccaagagaccuuuugugaaacugaacguugagaccgauacagccgaaauccggcuuaugugcaccgacacauaucuggauacgccccgcccugacgauggcagcauuaccgggcccugugagucuaacggagacaagggcuccgggggaaucaaaggcggcuucgugcaccagagaauggcuagcaagaucgggcggugguacucuagaacaaugagcaaaaccgagcgcaagggaaugggccucuaugucaaauacgacggggaucccuggaccgacuccgaugcgcuggccuuucggggagugauggugucuaugaaggaaccuggcugguacagcuucggguucgagauuaaggacaaaaagugcgaugucccguguaucggcauugaaaugguucaugacggaggcaaagagacauggcacuccgcugccaccgccaucuauugccugauggggagcggacaacuccugugggauacagugacgggcguggacauggcucuuuga

SEQ ID NO: 211980 - RNA, 1401 nt, Artificial Sequence
  derived and/or modified sequence opt5 from neuraminidase__InfluenzaB__AFF18545
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaaggguccggaggcaucaagggcggguucgugcaccagcggauggcuagcaaaaucggacgcugguacucuagaacaaugagcaagaccgagcggaaaggcauggggcucuaugucaaguacgacggagaucccuggaccgacuccgaugcgcuggccuuuagaggcgugauggugucuaugaaggaaccugggugguacagcuucggcuucgagauuaaagacaagaaaugcgaugucccguguaucggaauugaaaugguucaugacggcgggaaggagacauggcacuccgcugccaccgccaucuauugccugaugggaagcggccaacuccugugggauacagugacggggguggacauggcucuuuga

SEQ ID NO: 211981 - RNA, 1401 nt, Artificial Sequence; identical to SEQ ID NO: 211841
  derived and/or modified sequence opt5 from neuraminidase__InfluenzaB__AFH34933

SEQ ID NO: 211982 - RNA, 1401 nt, Artificial Sequence; identical to SEQ ID NO: 211841
  derived and/or modified sequence opt5 from neuraminidase__InfluenzaB__AFH34939

SEQ ID NO: 211983 - RNA, 1401 nt, Artificial Sequence; identical to SEQ ID NO: 211779
  derived and/or modified sequence opt5 from neuraminidase__InfluenzaB__AFH57869

SEQ ID NO: 211984 - RNA, 1401 nt, Artificial Sequence
  derived and/or modified sequence opt5 from neuraminidase__InfluenzaB__AFH57891
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauuaugccaacgcgucuaauguucaggcugugaaccacagcgccgccaaaggagugacacugcuucugcccgaaccugaguggaccuaccccagacucuccugcccuggcagcacauuccagaaggcucugcuuaucucuccccaucgguuuggggaaaccaaaggaaauuccgccccucugauuauccgcgagccguucaucgcuuguggccccacggaaugcaagcacuuugcccucacccauuaugcggcccagccugggggauacuauaacggcacaagagaggaccggaauaaacugcgccaccugauuagcgucaagcucggcaagauccccaccguggagaacucuauuuuccauauggcugccugguccgggagcgcuugucacgauggaaaagaauggacauacaucggcguugacgggccugauucuaaugcccugcuuaagauuaaauacggagaggcguauaccgacacguaccacuccuaugccaagaacauccugagaacacaagaaagcgcuugcaauuguauuggcggggauugcuaccucaugaucaccgacggacccgccuccggcaucucugagugucgguuucugaaaauucgcgagggcagaaucauuaaggaaaucuucccgacagggcgggugaagcauaccgaggaaugcaccuguggauuugcuagcaacaaaacaauugagugcgccugucgcgauaauuccuauacggccaagagaccuuucgucaaacuuaacguggaaaccgacacagcugagauccggcugaugugcaccgagacauaccucgauacgccccgcccuaaugacggcagcaucaccgggcccugcgaaucugauggagacaagggcuccgggggaauuaaaggcggcuuuguucaccagagaauggcgagcaagaucgggcggugguauucucgcacaaugagcaaaaccaagagaaugggaaugggccuguacgugaaguacgacggggaucccuggaccgacuccgaggcccuggcucucucuggagucauggugagcauggaggaaccuggcugguauuccuucggguuugaaauuaaagauaagaaaugugacgugccgugcaucggcauugagaugguccaugauggaggcaagacaaccuggcacagcgccgccacagcuaucuacugucugauggggucuggacagcuucugugggacacgguuaccggcguggauauggcccucuga

SEQ ID NO: 211985 - RNA, 1401 nt, Artificial Sequence
  derived and/or modified sequence opt5 from neuraminidase__InfluenzaB__AFH57913
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcuggccuucucuggcgugauggucagcaugaaggagccugggugguacuccuuuggcuucgaaaucaaagauaagaaaugcgacguuccguguauuggaaucgagauggugcacgauggcgggaaggaaacauggcauagcgcugccaccgccauuuauugccucaugggaucuggccagcugcuuugggacacagugacgggggucgauauggcucuguga

SEQ ID NO: 211986 - RNA, 1401 nt, Artificial Sequence; identical to SEQ ID NO: 211841
  derived and/or modified sequence opt5 from neuraminidase__InfluenzaB__AFH57935

SEQ ID NO: 211987 - RNA, 1401 nt, Artificial Sequence; identical to SEQ ID NO: 211841
  derived and/or modified sequence opt5 from neuraminidase__InfluenzaB__AFH57946

SEQ ID NO: 211988 - RNA, 1401 nt, Artificial Sequence; identical to SEQ ID NO: 211841
  derived and/or modified sequence opt5 from neuraminidase__InfluenzaB__AFH57957

SEQ ID NO: 211989 - RNA, 1401 nt, Artificial Sequence; identical to SEQ ID NO: 211919
  derived and/or modified sequence opt5 from neuraminidase__InfluenzaB__AFH57968

SEQ ID NO: 211990 - RNA, 1401 nt, Artificial Sequence
  derived and/or modified sequence opt5 from neuraminidase__InfluenzaB__AFH57979
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugauuuuccuucugcccgaaccugaguggacauauccccggcucuccuguccuggcagcaccuuucagaaggcccugcuuaucucuccccaccgcuucggggaaacgaaaggaaauuccgcuccucugauuaucagagagccguuuaucgccugcggccccaacgaauguaagcauuucgcucucacccacuacgccgcgcagccugggggauauuacaauggcacacggggcgaccgcaacaaacugagacaucugauuagcgucaagcucgggaagauccccaccguggaaaauucuauuuuucacauggccgcuugguccggaagcgccugccaugauggcaaagaguggacauauaucgggguugacggaccugauaacgacgcucugcuuaaggugaaauacggcgaggccuacaccgauacguaucacucuuacgcgaauaagauucugcggacacaggaguccgccuguaacugcaucgggggaaauuguuaucucaugauuaccgacggcagcgcuuccggcgucucugaaugccgcuuccugaaaaucagagaggggcggaucauuaaggagaucuuucccacaggacgcgugaagcacaccgaagaguguaccugcggcuucgccagcaacaaaacaauugaaugugcuugcagagauaauuccuacacggccaagcggccguuuguuaaacuuaacguggagaccgacacagccgaaauccgccugaugugcaccgauacauaucucgacaccccuagacccgaugacgggagcauuacgggaccuugugagucuaauggcgacaagggguccggaggcaucaaaggcggguucguccaucaacggauggagagcaagaucggacgcugguacucuagaacaaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaauuaaagauaagaaaugcgacguuccuuguaucggaauugagauggugcacgauggcgggaaggaaaccuggcauagcgcugccacagccaucuauugccucaugggaucuggccagcugcuuugggacaccgugacaggggucgauauggcucuguga

SEQ ID NO: 211991 - RNA, 1401 nt, Artificial Sequence; identical to SEQ ID NO: 211608
  derived and/or modified sequence opt5 from neuraminidase__InfluenzaB__AFH58253

SEQ ID NO: 211992 - RNA, 1401 nt, Artificial Sequence; identical to SEQ ID NO: 211671
  derived and/or modified sequence opt5 from neuraminidase__InfluenzaB__AFH58264

SEQ ID NO: 211993 - RNA, 1401 nt, Artificial Sequence; identical to SEQ ID NO: 211812
  derived and/or modified sequence opt5 from neuraminidase__InfluenzaB__AFH58275

SEQ ID NO: 211994 - RNA, 1401 nt, Artificial Sequence; identical to SEQ ID NO: 211812
  derived and/or modified sequence opt5 from neuraminidase__InfluenzaB__AFH58286

SEQ ID NO: 211995 - RNA, 1401 nt, Artificial Sequence; identical to SEQ ID NO: 211985
  derived and/or modified sequence opt5 from neuraminidase__InfluenzaB__AFH58297

SEQ ID NO: 211996 - RNA, 1401 nt, Artificial Sequence
  derived and/or modified sequence opt5 from neuraminidase__InfluenzaB__AFH58308
augcugcccagcaccauccagacacucacgcuguuccuuaccuccggcggggugcugcucucucuguacgucagcgccucccuuucuuaucugcucuacagcgacauucugcugaaguuuuccagaacagagaccacagcuccuaucaugccgcucgauugcgccaacgcgucuaauguucaagcugugaaccggagcgccaccaaaggagugacacugcuucugcccgaaccugaguggaccuauccccgccucuccuguccuggcagcacguuccagaaggcccugcuuauuucuccccacagauuuggggaaaccaaaggaaauuccgcuccucugaucauucgggagccguucaucgccugcggccccaaggaauguaaacauuuugcucucacacacuacgccgcgcagccugggggauauuacaacggcacccgcgaggacagaaauaagcugcggcaucugaucagcgucaagcucggcaaaauucccacaguggagaacucuaucuuccacauggccgcuugguccgggagcgccugccaugauggacgcgaauggaccuauauuggcguugacgggccugauucuaaugcucugcuuaagaucaaauacggagaggccuacacggacacauaucacuccuacgcgaagaacauucugagaacccaggaaagcgccuguaauugcaucggcggggauuguuaucucaugauuacagacggacccgcuuccggcaucucugagugccgguuucugaaaauccgcgagggcagaauuaucaaggaaauuuucccgaccgggcgggugaagcacaccgaggaauguacaugcggauuugccagcaacaaaacgaucgagugugcuugccgcgauaauuccuacaccgccaagagaccuuucgucaaacuuaacguggaaacagacaccgccgagauucggcugaugugcacagagaccuaucucgauacgccccgcccuaaugacggcagcaucacagggcccugugaaucuaacggagauaagggcuccgggggaaucaaaggcggcuuuguucaucaaagaauggcuagcaagauugggcggugguacucuagaaccaugagcaaaaccaagcgcaugggaaugggccuguaugugaaguacgacggggaccccuggacagauuccgaggcgcuggcccucucuggagucauggugagcauggaggaaccuggcugguacuccuucggguuugaaaucaaagacaagaaaugcgaugugccguguauuggcaucgagaugguccacgacggaggcaagaccacauggcauagcgcugccacggccauuuauugccugauggggucuggacagcuucugugggauaccguuacaggcguggacauggcucucuga

SEQ ID NO: 211997 - RNA, 1401 nt, Artificial Sequence; identical to SEQ ID NO: 211996
  derived and/or modified sequence opt5 from neuraminidase__InfluenzaB__AFH58319

SEQ ID NO: 211998 - RNA, 1401 nt, Artificial Sequence
  derived and/or modified sequence opt5 from neuraminidase__InfluenzaB__AFH58341
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcguccgccucggcaagauccccaccguggagaacucuauuuuccacauggccgcuugguccgggagcgccugccaugauggaagagaauggacauauaucggcguugacgggccugauucuaaugcucugcuuaaaauuaaguacggagaggccuacaccgacacguaucacuccuacgcgaaaaacauccugcggacacaggaaagcgccuguaauugcauuggcggggauuguuaucucaugaucaccgacggacccgcuuccggcaucucugagugccgcuuucugaagauuagagagggccggaucauuaaagaaaucuucccgacagggcgcgugaagcacaccgaggaauguaccugcggauuugccagcaacaagacaauugagugugcuugcagagauaauuccuacacggccaaacggccuuucgucaaacuuaacguggaaaccgacacagccgagauccgccugaugugcaccgagacauaucucgauacccccagaccuaaugacggcagcaucacggggcccugugaaucuaacggagauaagggcuccgggggaauuaagggcggcuuuguucaucaacggauggcuagcaaaaucgggagaugguacucucgcacaaugagcaagaccaaacggaugggaaugggccuguaugugaaguacgacggggaccccuggaccgauuccgaggcgcuggcccucucuggagucauggugagcauggaggaaccuggcugguacuccuucggguuugaaauuaaggacaaaaagugcgaugugccguguaucggcauugagaugguccacgacggaggcaaaacaaccuggcauagcgcugccacagccaucuauugccugauggggucuggacagcuucugugggauacgguuaccggcgugaauaugacacucuga

SEQ ID NO: 211999 - RNA, 1401 nt, Artificial Sequence
  derived and/or modified sequence opt5 from neuraminidase__InfluenzaB__AFH58363
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaaggaauguaaacauuucgcucugacacacuacgccgcgcagcccgggggauauuacaacggcacccggggcgaccgcaauaagcucagacaucugaucagcgucaagcuggggaaaauuccuacaguggagaacucuaucuuucacauggccgcuugguccggaagcgccugccaugauggcaaggaguggaccuauauugggguugacggacccgauaauaacgcucuccugaaaaucaaguacggcgaagccuacacggacacauaucacucuuacgcgaauaacauucuucggacccaggaguccgccuguaauugcaucgggggaaacuguuaucugaugauuacagauggcagcgcuuccggcgugucugaaugccgcuuccucaaaaucagagaggggcggaucauuaaggagaucuuuccgaccggacgcauuaagcacaccgaagaguguacaugcggcuucgccagcaauaaaacgaucgaaugugcuugcagagacaacuccuacaccgccaagcggccuuuugucaaacugaauguggagacagauaccgccgaaauucgccuuaugugcacagagaccuaucuggacacgcccagaccugaugacgggagcaucacaggacccugugagucuaacggcgggaagggauccggcggcaucaaagggggauucguucaucaacggauggcuagcaagauuggccgcugguacucuagaaccaugagcaaaaccgaacggaaggggaugggacucuaugugaaguacgauggcgaccccugggcggacuccgaugcccuggcuuuuucuggggucauggugagcauggaggaaccuggcugguacuccuucggauucgagaucaaagacaagaaaugcgaugugccguguauuggcaucgaaaugguccacgacgggggaaaggagacauggcauagcgccgccaccgcuauuuauugccugaugggcucugggcagcuccugugggauacaguuacgggagugaacauggcccuuuga

SEQ ID NO: 212000 - RNA, 1401 nt, Artificial Sequence; identical to SEQ ID NO: 211999
  derived and/or modified sequence opt5 from neuraminidase__InfluenzaB__AFH58374

SEQ ID NO: 212001 - RNA, 1401 nt, Artificial Sequence; identical to SEQ ID NO: 211985
  derived and/or modified sequence opt5 from neuraminidase__InfluenzaB__AFH58385

SEQ ID NO: 212002 - RNA, 1401 nt, Artificial Sequence; identical to SEQ ID NO: 211985
  derived and/or modified sequence opt5 from neuraminidase__InfluenzaB__AFH58396

SEQ ID NO: 212003 - RNA, 1401 nt, Artificial Sequence; identical to SEQ ID NO: 211985
  derived and/or modified sequence opt5 from neuraminidase__InfluenzaB__AFH58407

SEQ ID NO: 212004 - RNA, 1401 nt, Artificial Sequence; identical to SEQ ID NO: 211985
  derived and/or modified sequence opt5 from neuraminidase__InfluenzaB__AFH58418

SEQ ID NO: 212005 - RNA, 1401 nt, Artificial Sequence
  derived and/or modified sequence opt5 from neuraminidase__InfluenzaB__AFH58429
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaaugaaacgaucgagugugcuugcagagacaacuccuacaccgccaaacggccuuucguuaaacuuaauguggaaacagauaccgccgagauucgccugaugugcacagacaccuaucucgauacgcccagaccuaacgacgggagcaucacaggacccugugagucuaacggcgauaagggguccggaggcauuaagggcggguuuguccaucaacggauggaaagcaaaaucggacgcugguacucuagaaccaugagcaagaccgagcggaugggcauggggcuguaugugaaauacgacggagaccccugggcugauuccgacgcgcuggccuucucuggcgugauggucagcaugaaggaaccugggugguacuccuuuggcuucgagaucaaggauaaaaagugcgacguuccguguauuggaaucgaaauggugcacgauggcgggaaagagacauggcauagcgcugccaccgccauuuauugccucaugggaucuggccagcugcuuugggacacagugacgggggucgauauggcucuguga

SEQ ID NO: 212006 - RNA, 1401 nt, Artificial Sequence
  derived and/or modified sequence opt5 from neuraminidase__InfluenzaB__AFH58440
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauucaagaggggagaaucaucaaggagauuuucccgaccggacgggugaagcacaccgaagaguguacaugcggcuuugccagcaauaaaacgaucgaaugugcuugccgcgacaacuccuacaccgccaagagaccuuucguuaaacuuaauguggagacagauaccgccgaaauucggcugaugugcacagacaccuaucucgauacgccccgcccuaacgacgggagcaucacaggacccugugagucuaacggcgauaagggguccggaggcauuaaaggcggguuuguccaucagagaauggagagcaagaucggacggugguacucucgcaccaugagcaaaaccgaaagaaugggcauggggcuguaugugaaguacgacggagaccccugggcugauuccgacgcgcuggccuucucuggcgugauggucagcaugaaggagccugggugguacuccuuuggcuucgaaaucaaagauaagaaaugcgacguuccguguauuggaaucgagauggugcacgauggcgggaaggaaacauggcauagcgcugccaccgccauuuauugccucaugggaucuggccagcugcuuugggacacagugacgggggucgauauggcucuguga

SEQ ID NO: 212007 - RNA, 1401 nt, Artificial Sequence
  derived and/or modified sequence opt5 from neuraminidase__InfluenzaB__AFH58462
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaacgaauguaagcauuucgcucugacacacuacgccgcgcagcccgggggauauuacaauggcacccggggcgaccgcaacaaacucagacaucugaucagcgucaagcuggggaagauuccuacaguggaaaauucuaucuuucacauggccgcuugguccggaagcgccugccaugauggcaaagaguggaccuauauugggguugacggacccgauaacaaugcucuccugaaggugaaauacggcgaggccuacacggacacauaucacucuuacgcgaacaagauccuucggacccaggaguccgccuguaauugcauugggggaaacuguuaucugaugaucacagauggcagcgcuuccggcgucucugaaugccgcuuccucaaaauuagagaggggcggaucaucaaggagauuuuuccgaccggacgcgugaagcacaccgaagaguguacaugcggcuucgccagcaauaaaacgaucgaaugugcuugcagagacaacuccuacaccgccaagcggccuuuuguuaaacugaauguggagacagauaccgccgaaauucgccuuaugugcacagacaccuaucuggauacgcccagaccugacgaugggagcaucacaggacccugugagucuaacggcgacgagggguccggaggcauuaagggcggguucguccaucaacggauggaaagcaaaaucggacgcugguacucuagaaccaugagcaagaccgagcggaugggcauggggcucuaugugaaauacgacggagaucccugggcugacuccgaugcgcuggccuuuucuggcgugauggucagcaugaaggaaccugggugguacuccuucggcuucgagaucaaggacaaaaagugcgauguuccguguauuggaaucgaaauggugcacgacggcgggaaagagacauggcauagcgcugccaccgccauuuauugccugaugggaucuggccagcuccugugggauacagugacgggggucgacaugacccuuuga

SEQ ID NO: 212008 - RNA, 1401 nt, Artificial Sequence; identical to SEQ ID NO: 212007
  derived and/or modified sequence opt5 from neuraminidase__InfluenzaB__AFH58473

SEQ ID NO: 212009 - RNA, 1401 nt, Artificial Sequence; identical to SEQ ID NO: 211841
  derived and/or modified sequence opt5 from neuraminidase__InfluenzaB__AFH58484

SEQ ID NO: 212010 - RNA, 1401 nt, Artificial Sequence; identical to SEQ ID NO: 211841
  derived and/or modified sequence opt5 from neuraminidase__InfluenzaB__AFH58495

SEQ ID NO: 212011 - RNA, 1401 nt, Artificial Sequence; identical to SEQ ID NO: 211841
  derived and/or modified sequence opt5 from neuraminidase__InfluenzaB__AFH58506

SEQ ID NO: 212012 - RNA, 1401 nt, Artificial Sequence
  derived and/or modified sequence opt5 from neuraminidase__InfluenzaB__AFH58517
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaacauggcauagcgcugccaccgccauuuauugccucaugggaucuggcagacugcuuugggacacagugacgggggucgauauggcucuguga

SEQ ID NO: 212013 - RNA, 1401 nt, Artificial Sequence; identical to SEQ ID NO: 211919
  derived and/or modified sequence opt5 from neuraminidase__InfluenzaB__AFH58528

SEQ ID NO: 212014 - RNA, 1401 nt, Artificial Sequence
  derived and/or modified sequence opt5 from neuraminidase__InfluenzaB__AFH58539
augcugcccagcaccgugcagacacucacgcugcuucugaccuccggcgggguccuccugucucuuuacguuagcgccucccugucuuaucuccuguacagcgacgugcugcucaaguucuccucuacaaaaaccacagcuccuaccaugagccuggagugcacaaacgccuccaaugcgcaaaccgugaaccacagcgcuacgaaggaaaugaccuuuccgcccccugagcccgaauggacauauccuagacuuucuugucagggauccaccuuccagaaagcccugcucaucagcccccaucgguuuggcgagauuaagggaaauucugccccucugaucauucgcgaaccguucgucgcuugcgggcccaaagaguguagacacuuugcccuuacacauuacgcugcccagccuggcggguauuacaacggaacccggaaggaucgcaauaagcugagacaccucguguccguuaaacugggcaagauccccacgguggagaacagcauuuuccauauggcggccuggucuggcuccgcuugccacgacgggcgggaauggacauauaucggagucgauggcccugacaaugaugcccuggugaaaaucaaguacggggaggcuuacaccgacacauaucacagcuacgcccauaacauucuccgcacccaagaauccgcguguaauugcaucggaggcgauuguuaucugaugauuaccgacgggucugccagcggaaucuccaaaugcagauuucuuaagauucgggagggccgcaucauuaaggagauccugcccacaggcagaguugaacacacggaggaauguaccugcggguucgcuagcaacaaaacaaucgagugugccugccgggauaauucuuacaccgcuaagcgcccguuugugaaacucaacgucgaaacagacaccgccgagauuagacugaugugcacgaagacauaucuugauaccccucggcccgacgauggauccaucgccggcccuugugagagcaauggggacaaauggcugggaggcauuaaagggggauucgugcaucagcgcauggcuucuaagaucggcagaugguacagccggaccauguccaagacaaacagaaugggcauggaacucuaugugaaguacgacggggaucccuggaccgacucugaugcgcugacacugagcggagucaugguuuccauugaggaacccggcugguacagcuuuggguucgagaucaaagacaagaaaugcgaugugccuuguaucggaauugaaauggugcacgacggcgggaaggauacguggcacucugccgcuaccgccaucuauugccucaugggcuccggacagcugcuuugggacacagccaccggcgucgauauggcucuguga

SEQ ID NO: 212015 - RNA, 1401 nt, Artificial Sequence
  derived and/or modified sequence opt5 from neuraminidase__InfluenzaB__AFH58550
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaagaaaugacacugcuucugccugagcccgaauggaccuauccucggcucuccugucccggaagcacguuccagaaggcccugcuuauuucuccucaccgcuuuggcgagaccagaggaaauuccgcuccgcugacaauccgggaacccuucauugccugcgggccuaaagaguguaagcauuuugcucucacccacuacgccgcgcagcccggcggguauuacaacggaacacgcgaggacagaaauaaacugcggcaucugaucagcgugaagcucggcaagaucccuaccgucgaaaacucuauuuuccacauggccgcuugguccggcagcgccugccaugaugggcgcgaguggacguauaucggaguggacggccccgauucuaaugcucugauuaaaaucaaguacggggaagccuacacagacaccuaucacuccuacgcgaacaauauucuuagaacacaggagagcgccuguaacugcaucggaggcgauuguuaucugaugauuaccgacggguccgcuucuggaaucagcaaaugccgguuucucaagauccgcgagggcagaauuaucaaagaaauuuucccgaccggccggguugagcacacagaagaguguacgugcggguuugccuccaauaagaccaucgaaugugcuugccgcgauaacagcuacacagccaagagaccuuucgugaaacugaaugucgagaccgacacagccgagauucggcuuaugugcaccgaaacguaucuggauacaccccgcccugacgauggaucuaucaccggccccugugaguccaacggggacaagggaagaggcgggaucaaaggaggcuuugugcaucaacggauggcuagcaagauuggcagaugguacucucgcaccaugagcaaaacagaacggauggggauggagcucuauguuaaguacgacggagaucccuggaccgacuccgaagcgcuggccccuucuggcgugauggucagcauggaggagccggggugguacuccuucggauuugaaaucaaagauaagaagugcgacgugcccuguauuggcaucgagauggugcacgaugggggcaaaaagacauggcauagcgcugccacggccauuuauugccugaugggaucuggccagcuccugugggacaccgucacagggguugauauggcucuuuga

SEQ ID NO: 212016 - RNA, 1401 nt, Artificial Sequence; identical to SEQ ID NO: 212015
  derived and/or modified sequence opt5 from neuraminidase__InfluenzaB__AFH58561

SEQ ID NO: 212017 - RNA, 1401 nt, Artificial Sequence
  derived and/or modified sequence opt5 from neuraminidase__InfluenzaB__AFJ69969
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccuggacagauuccgacgcucuggcguucucuggcgugauggucagcaugaaggagccugggugguacuccuuuggcuucgaaaucaaagauaagaaaugcgacguuccguguauuggaaucgagauggugcacgauggcgggaaggaaaccuggcauagcgccgcuacagccauuuauugccucaugggaucuggccagcugcuuugggacacggugaccggggucgauauggcccuguga

SEQ ID NO: 212018 - RNA, 1401 nt, Artificial Sequence; identical to SEQ ID NO: 211980
  derived and/or modified sequence opt5 from neuraminidase__InfluenzaB__AFJ69971

SEQ ID NO: 212019 - RNA, 1401 nt, Artificial Sequence
  derived and/or modified sequence opt5 from neuraminidase__InfluenzaB__AFJ69973
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugccugccgcuuccucaagaucagagaagggcggaucauuaaagagaucuuuccgacaggacgcgucaagcauaccgaggaauguaccugcggcuucgcuagcaacaagacaauugagugugccugcagagacaauuccuacacggccaaacggccuuuugugaagcugaacguugaaaccgauacagcugagauccgccuuaugugcaccgacacauaucuggauacccccagaccugacgaugggagcauuacgggacccugugaaucuaacggcgacaaaggguccggaggcaucaagggcggguucgugcaccagcggauggcgagcaaaaucggacgcugguacucuagaacaaugagcaagaccgagcggaaaggcauggggcucuaugucaaguacgacggagaucccuggaccgacuccgaugcccuggcuuuuagaggcgugauggugucuaugaaggagccugggugguacagcuucggcuucgaaauuaaagacaagaaaugcgaugucccguguaucggaauugagaugguucaugacggcgggaaggaaacauggcacuccgccgccaccgcuaucuauugccugaugggaagcggccaacuccugugggauacagugacggggguggacauggcccuuuga

SEQ ID NO: 212020 - RNA, 1401 nt, Artificial Sequence; identical to SEQ ID NO: 211841
  derived and/or modified sequence opt5 from neuraminidase__InfluenzaB__AFJ69975

SEQ ID NO: 212021 - RNA, 1401 nt, Artificial Sequence
  derived and/or modified sequence opt5 from neuraminidase__InfluenzaB__AFJ69979
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacaccucuaauguucaagcggugaaccacagcgcuacaaaaggagugacccugcuucugccugaacccgaguggacguauccuagacucuccugucccggcagcaccuuccagaaggcccugcuuauuucuccucaucgguuuggggaaacaaaaggaaauuccgccccgcugaucauucgcgagcccuucaucgcuugcggcccuaacgaauguaagcacuuugcccucacccauuacgcugcccagcccgggggauauuacaauggcacaagaggcgaccggaacaaacugcgccaccugaucagcgucaagcucgggaagauuccuaccguggaaaauucuaucuuccauauggcggccugguccggaagcgcuugccacgauggcaaagaguggacguauauugggguugacggacccgauaacaaugcccugcuuaaggugaaauacggcgaggcuuacacagacaccuaucacucuuacgccaacaagauccugagaacacaggaguccgcguguaauugcauugggggaaacuguuaucucaugaucaccgauggcagcgccuccggcgucucugaaugccgguuucugaaaauucgcgaggggagaaucaucaaggagauuuucccgaccggacgggugaagcauacagaagaguguacgugcggcuuugcuagcaauaaaaccaucgaaugugccugccgcgacaacuccuacacagcuaagagaccuuucguuaaacuuaauguggagaccgauacagccgaaauucggcugaugugcaccgacacguaucucgauacaccccgcccugacgaugggagcaucaccggacccugugagucuaacggcgacaagggguccggaggcauuaaaggcggguuuguccaccaaagaauggagagcaagaucggacggugguacucucgcaccaugagcaaaacagaaagaaugggcauggggcuguaugugaaguacgacggagaucccugggccgacuccgaugcucuggcguucucuggcgugauggucagcaugaaggagccugggugguacuccuuuggcuucgaaaucaaagacaagaaaugcgauguuccguguauuggaaucgagauggugcaugacggcgggaaggaaaccuggcacagcgccgcuacagccauuuauugccucaugggaucuggccagcugcuuugggauacggugaccggggucgacauggcccuguga

SEQ ID NO: 212022 - RNA, 1401 nt, Artificial Sequence; identical to SEQ ID NO: 211980
  derived and/or modified sequence opt5 from neuraminidase__InfluenzaB__AFJ69981

SEQ ID NO: 212023 - RNA, 1401 nt, Artificial Sequence
  derived and/or modified sequence opt5 from neuraminidase__InfluenzaB__AFJ69983
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagauccugccgacaggacgcgucaagcauaccgaagaguguaccugcggcuuugccagcaacaagacaauugaaugugcuugcagagacaauuccuacacggccaaacggccuuucgugaaacuuaacguugagaccgauacagccgaaauccgccugaugugcaccgacacauaucucgauacccccagaccugacgaugggagcauuacgggacccugugagucuaacggcgggaagggauccggcggcaucaaagggggauuugugcaccagcggauggcuagcaagaucggccgcugguacucuagaacaaugagcaagaccgagcggaaagggaugggacuguaugucaaguacgacggcgaccccuggaccgauuccgacgcgcuggccuucagaggggugauggugucuaugaaggaaccuggcugguacagcuuuggauucgagauuaaagauaagaaaugcgacgucccguguaucggcauugaaaugguucaugaugggggaaaggagacauggcacuccgcugccaccgccaucuauugccucaugggcagcgggcaacugcuuugggacacagugacgggaguggauauggcucuguga

SEQ ID NO: 212024 - RNA, 1401 nt, Artificial Sequence
  derived and/or modified sequence opt5 from neuraminidase__InfluenzaB__AFJ69987
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcaccaaaggcggguuuguccaucaacgcaugaaguccaaaauuggaagaugguacagccggaccaugucuaagacagagagaaugggcauggggcuguaugugaaguacgacggagaucccugggcugacagcgaugcgcugaccuucuccggcgugauggucucuaugaaagaaccugggugguacagcuuuggcuucgagaucaaggacaaaaagugcgauguuccguguaucggaauugaaauggugcacgacggcgggaaagagacauggcauuccgccgcuacggccaucuauugccucaugggaagcggccagcugcuuugggauaccgugacaggggucgacauggcccuguga

SEQ ID NO: 212025 - RNA, 1401 nt, Artificial Sequence
  derived and/or modified sequence opt5 from neuraminidase__InfluenzaB__AFJ76228
augcugcccagcaccauccagacacucacgcuguuccuuaccuccggcggggugcugcucucucuguacgucagcgccucccuuucuuaucugcucuacagcggcauucugcugaaguuuuccccuacagagaucaccgcuccgacaaugccccucaacugcgccaaugcgucuaacguucaagcugugaauagaagcgccaccaaaggagugacacugcuucugccugaacccgaguggaccuauccucggcucuccugucccgggagcacguuccagaaggcccugcuuauuucuccucaccgcuuuggagaaaccaaaggcaacuccgcuccgcugaucauuagagagcccuucaucgccugcgggccuaaggaauguaaacauuuugcucucacacacuacgccgcgcagcccggaggcuauuacaauggcacccgggaggaccgcaacaagcugagacaucugaucagcgucaagcucgggaaaauuccuacaguggaaaauucuaucuuccacauggccgcuugguccggaagcgccugccaugauggccgggaauggaccuauauugggguugacggacccgauucuaacgcucugcuuaagaucaaauacggcgaggccuacacggacacauaucacuccuacgcgaauaacauucugcgcacccaggaaagcgccuguaauugcaucgggggagauuguuaucucaugauuacagacggcuccgcuucuggcaucagcgagugcagauuucugaagauccgggaggggcgcauuaucaaagaaauuuucccgaccggaagaguggagcacaccgaagaguguacaugcggcuuugccuccaacaagacgaucgaaugugcuugccgggauaauagcuacaccgccaagcgcccuuucgucaaacuuaacguggagacagacaccgccgagauuagacugaugugcacagaaaccuaucucgauacgccccggccugacgaugggucuaucacaggacccugugaguccaauggcgacaaggggagcggaggcaucaaaggcggguuuguucaucaacgcauggcuucuaagauuggaagaugguacagccggaccauguccaaaaccaagagaaugggcauggggcuguaugugaaauacgauggagaccccuggaucgacucugaugcgcugacacucagcggcgucaugguguccauggaggagccugggugguacagcuucggcuuugaaauuaaggacaagaaaugcgaugugccguguaucggaauugagaugguccacgacggcgggaagaaaaccuggcauucugccgcuacagccaucuauugccugaugggauccggccagcuucugugggauacgguuaccgggguggacauggcccucuga

SEQ ID NO: 212026 - RNA, 1401 nt, Artificial Sequence; identical to SEQ ID NO: 211692
  derived and/or modified sequence opt5 from neuraminidase__InfluenzaB__AFJ76261

SEQ ID NO: 212027 - RNA, 1401 nt, Artificial Sequence
  derived and/or modified sequence opt5 from neuraminidase__InfluenzaB__AFJ76283
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccgucaagcucgggaaaauucccacaguggagaacagcaucuuccacauggccgcuuggucuggauccgccugccaugauggcaaggaguggaccuauauugggguugacggaccggauaauaacgcucugcuuaaaaucaaguacggcgaagccuacacggacacauaucacagcuacgcgaauaacauucugcggacccaggagucugccuguaauugcaucgggggaaacuguuaucucaugauuacagauggcuccgcuagcggcguguccgaaugccgcuuucugaaaaucagagaggggcggaucauuaaggagaucuucccuaccggacgcauuaagcacaccgaagaguguacaugcggcuuugccucuaauaaaacgaucgaaugugcuugcagagacaacagcuacaccgccaagcggcccuucgucaaacuuaauguggagacagauaccgccgaaauucgccugaugugcacagagaccuaucucgacacgccuagacccgaugacggguccaucacaggacccugugagagcaacggcgauaaggggucuggaggcaucaaaggcggguuuguucaucaacggauggcuuccaagauuggacgcugguacagcagaaccaugucuaaaaccgaacggaugggcauggggcuguaugugaaguacgacggagacccuugggcggauagcgacgcccugacauucuccggcgucauggugucuauggaggaaccggggugguacagcuuuggcuucgagaucaaggauaaaaagugcgacgugcccuguauuggaaucgaaaugguccacgauggcgggaaagagaccuggcauuccgcugccacagccauuuauugccucaugggaagcggccagcugcuuugggacacgguuaccggggugaacauggcucuguga

SEQ ID NO: 212028 - RNA, 1401 nt, Artificial Sequence
  derived and/or modified sequence opt5 from neuraminidase__InfluenzaB__AFJ76305
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagcgcgcccugcuuauuucuccucacagauuuggggaaaccaagggaaauuccgcuccgcugaucauucgggagcccuucaucgccugcggcccuaaagaauguaagcauuuugcucucacacacuacgccgcgcagcccgggggauauuacaacggcacccgcggcgacagaaauaaacugcggcaucugaucagcgucaagcucgggaagauuccuacaguggagaacucuaucuuccacauggccgcuugguccggaagcgccugccaugauggcaaagaguggaccuauauugggguugacggacccgauaauaacgcucugcuuaagaucaaauacggcgaagccuacacggacacauaucacucuuacgcgaauaacauucugcgcacccaggaguccgccuguaauugcaucgggggaaacuguuaucucaugauuacagauggcagcgcuuccggcgugucugaaugcagauuucugaagauccgggaggggcgcaucauuaaagagaucuucccgaccggaagaauuaagcacaccgaagaguguacaugcggcuuugccagcaauaagacgaucgaaugugcuugccgggacaacuccuacaccgccaaacgcccuuucgucaaacuuaauguggagacagauaccgccgaaauuagacugaugugcacagagaccuaucucgacacgccccggccugaugacgggagcaucacaggacccugugagucuaacggcgauaagggguccggaggcaucaagggcggguuuguucaucaacgcauggcuagcaaaauuggaagaugguacucucggaccaugagcaagaccgaaagaaugggcauggggcuguaugugaaauacgacggagaccccugggcggauuccgacgcccugacauucucuggcgucauggugagcauggaggaaccugggugguacuccuuuggcuucgagaucaaggauaagaaaugcgacgugccguguauuggaaucgaaaugguccacgauggcgggaaggagaccuggcauagcgcugccacagccauuuauugccucaugggaucuggccagcugcuuugggacacgguuaccgggguggauauggcucuguga

SEQ ID NO: 212029 - RNA, 1401 nt, Artificial Sequence
  derived and/or modified sequence opt5 from neuraminidase__InfluenzaB__AFJ76316
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccgaacggaugggcauggggcuguaugugaaguacgacggagaccccugggcggauuccgacgcccugacauucucuggcgucauggugagcauggaggaaccugggugguacuccuuuggcuucgagaucaaggauaaaaagugcgacgugccguguauuggaaucgaaaugguccacgauggcgggaaagagaccuggcauagcgcugccacagccauuuauugccucaugggaucuggccagcugcuuugggacacgguuaccggggugaacauggcucuguga

SEQ ID NO: 212030 - RNA, 1401 nt, Artificial Sequence; identical to SEQ ID NO: 211692
  derived and/or modified sequence opt5 from neuraminidase__InfluenzaB__AFJ76338

SEQ ID NO: 212031 - RNA, 1401 nt, Artificial Sequence
  derived and/or modified sequence opt5 from neuraminidase__InfluenzaB__AFJ77331
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccgccaaaggagugacacugcuucugcccgaaccugaguggaccuaucccagacucuccuguccuggcagcacauuccagaaggcucugcuuaucucuccccaucgguuuggggaaaccaaaggaaauuccgccccucugauuauccgcgagccguucaucgcuugcggccccacggaauguaagcacuuugcccucacccauuacgcggcccagccugggggauauuacaacggcacaagagaggaccggaauaaacugcgccaccugauuagcgucaagcucggcaagauccccaccguggagaacucuauuuuccauauggcugccugguccgggagcgcuugccacgauggaaaagaauggacauauaucggcguugacgggccugauucuaaugcccugcuuaagauuaaauacggagaggcguacaccgacacguaucacuccuacgccaagaacauccugagaacacaagaaagcgcuuauaauuguauuggcggggauugcuaccucaugaucaccgacggacccgccuccggcaucucugagugucgguuucugaaaauucgcgagggcagaaucauuaaggaaaucuucccgacagggcgggugaagcauaccgaggaaugcaccuguggauuugcuagcaacaaaacaauugagugcgccugucgcgauaauuccuauacggccaagagaccuuucgucaaacuuaacguggaaaccgacacagcugagauccggcugaugugcaccgagacauaccucgauacgccccgcccuaaugacggcagcaucaccgggcccugcgaaucugauggagacaagggcuccgggggaauuaaaggcggcuuuguucaccagagaauggcgagcaagaucgggcggugguauucucgcacaaugagcaaaaccaagagaaugggaaugggccuguacgugaaguacgacggggaucccuggaccgacuccgaggcccuggcucucucuggagucauggugagcauggaggaaccuggcugguauuccuucggguuugaaauuaaagauaagaaaugugacgugccgugcaucggcauugagaugguccaugauggaggcaagacaaccuggcacagcgccgccacagcuaucuacugucugauggggucuggacagcuucugugggacacgguuaccggcguggauauggcccucuga

SEQ ID NO: 212032 - RNA, 1401 nt, Artificial Sequence; identical to SEQ ID NO: 211767
  derived and/or modified sequence opt5 from neuraminidase__InfluenzaB__AFJ77351

SEQ ID NO: 212033 - RNA, 1401 nt, Artificial Sequence; identical to SEQ ID NO: 211659
  derived and/or modified sequence opt5 from neuraminidase__InfluenzaB__AFJ77362

SEQ ID NO: 212034 - RNA, 1401 nt, Artificial Sequence; identical to SEQ ID NO: 211812
  derived and/or modified sequence opt5 from neuraminidase__InfluenzaB__AFJ77384

SEQ ID NO: 212035 - RNA, 1401 nt, Artificial Sequence; identical to SEQ ID NO: 211734
  derived and/or modified sequence opt5 from neuraminidase__InfluenzaB__AFJ80132

SEQ ID NO: 212036 - RNA, 1401 nt, Artificial Sequence
  derived and/or modified sequence opt5 from neuraminidase__InfluenzaB__AFJ80143
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggacgggaauggaccuauauuggcguugacgggcccgauucuaaugcucugcuuaagaucaaauacggagaggccuacacggacacauaucacuccuacgcgaacaauauucugcgcacccaggaaagcgccuguaacugcaucggcgggaauuguuaucucaugauuacagauggauccgcuucuggcaucagcgagugcagauuucugaagauccgggagggccgcauuaucaaagaaauuuucccgaccgggagaguggagcacaccgaagaguguacaugcggauuugccuccaacaagacgaucgaaugugcuugccgggacaauagcuacaccgccaagcgcccuuucgucaaacuuaacguggagacagauaccgccgagauuagacugaugugcacagaaaccuaucucgacacgccccggccugaugacggcucuaucacagggcccugugaguccaauggagauaagggcagcgggggaaucaaaggcggcuuuguucaucaacgcauggcuucuaagauugggagaugguacagccggaccauguccaaaaccaagagaaugggaaugggccuguaugugaaauacgacggggaccccuggacagauucugacgcgcuggcccucagcggagucaugguguccauggaggaaccuggcugguacagcuucggguuugaaaucaaggauaagaaaugcgacgugccguguauuggcaucgagaugguccacgauggaggcaagaaaaccuggcauucugcugccacagccauuuauugccugaugggguccggacagcuucugugggacacgguuaccggcguggauauggcucucuga

SEQ ID NO: 212037 - RNA, 1401 nt, Artificial Sequence
  derived and/or modified sequence opt5 from neuraminidase__InfluenzaB__AFJ80154
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggccauucugaucucuccucaccgcuuuggggaaaccaaaggaaauuccgcuccgcuuauuaucagagagcccuucaucgccugcggcccuaaggaauguaaacauuuugcucugacacacuacgccgcgcagcccgggggauauuacaacggcacccgggaggaccgcaauaagcucagacaucugauuagcgucaagcugggcaaaaucccuacaguggagaacucuauuuuccacauggccgcuugguccgggagcgccugccaugauggacgggaauggaccuauaucggcguugacgggcccgauucuaaugcucuccugaagauuaaauacggagaggccuacacggacacauaucacuccuacgcgaacaauauccuucgcacccaggaaagcgccuguaacugcauuggcgggaauuguuaucugaugaucacagauggauccgcuucuggcaucagcgagugcagauuucucaagauucgggagggccgcaucauuaaagaaaucuucccgaccgggagaguggagcacaccgaagaguguacaugcggauuugccuccaacaagacgauugaaugugcuugccgggacaauagcuacaccgccaagcgcccuuucgucaaacugaacguggagacagauaccgccgagaucagacuuaugugcacagaaaccuaucuggacacgccccggccugaugacggcucuaucacagggcccugugaguccaauggagauaagggcagcgggggaauuaaaggcggcuuuguucaucaacgcauggcuucuaagaucgggagaugguacagccggaccauguccaaaaccaagagaaugggaaugggccucuaugugaaauacgacggggaccccuggacagauucugacgcgcuggcccugagcggagucaugguguccauggaggaaccuggcugguacagcuucggguuugaaauuaaggauaagaaaugcgacgugccguguaucggcauugagaugguccacgauggaggcaagaaaaccuggcauucugcugccacagccaucuauugccucaugggguccggacagcugcuuugggacacgguuaccggcguggauauggcucuguga

SEQ ID NO: 212038 - RNA, 1401 nt, Artificial Sequence
  derived and/or modified sequence opt5 from neuraminidase__InfluenzaB__AFJ80165
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaauuccccucgauugcgccaacgcgucuaauguucaagcugugaacagaagcgccaccaaaggagugacacugcuucugccugaacccgaguggaccuauccucggcucuccugucccggcagcacguuccagaaggcccugcuuaucucuccucaccgcuuuggggaaauuaaaggaaauuccgcuccgcugaucaucagagagcccuucauugccugcggcccuaaggaauguaaacauuuugcucucacccacuacgccgcgcagcccgggggauauuacaacggcacacgggaggaccgcaauaagcugagacaucugaucagcgucaagcucggcaaaauuccuaccguggagaacucuaucuuccacauggccgcuugguccgggagcgccugccaugauggaaaggaauggacauauauuggcguugacgggcccgauucuaaugcucugcuuaaaaucaaguacggagaggccuacaccgacacguaucacuccuacgcgaacaauauucugcggacacaggaaagcgccuguaacugcaucggcgggaauuguuaucucaugaucaccgauggauccgcuucuggcauuagcgagugccgcuuucugaaaaucagagagggccggauuaucaaggaaauuuucccgacagggcgcguggagcacaccgaagaguguaccugcggauuugccuccaacaagacaaucgaaugugcuugcagagacaauagcuacacggccaaacggccuuucgucaaacuuaacguggagaccgauacagccgagauccgccugaugugcaccgaaacauaucucgacacccccagaccugaugacggcucuauuacggggcccugugaguccaauggagauaagggcagcgggggaaucaagggcggcuuuguucaucaacggauggcuucuaaaauugggcgcugguacagcagaacaauguccaagaccaaacggaugggaaugggccuguaugugaaguacgacggggaccccuggaccgauucugacgcgcuggcccucagcggagucaugguguccauggaggaaccuggcugguacagcuucggguuugaaaucaaggauaaaaagugcgacauuccguguaucggcaucgagauggugcacgauggaggcaaagagacauggcauucugcugccaccgccauuuauugccugaugggguccggacagcuucugugggacacagucacgggcguugauauggcucucuga

SEQ ID NO: 212039 - RNA, 1401 nt, Artificial Sequence
  derived and/or modified sequence opt5 from neuraminidase__InfluenzaB__AFJ80176
augcugcccagcaccauccagacacucacgcuguuccuuaccuccggcggggugcugcucucucuguacgucagcgccucccuuucuuaucugcucuacagcgacauucugcugaaguuuuccccuacagagaucaccguuccgacaaugccccucgauugcgcuaacgccucuaaugugcaagcggugaacagaagcgcuaccaaaggagucacacugcuucugccugaacccgaguggaccuauccucggcucuccugucccggcagcacguuccagaaggcccugcuuauuucuccucaccgcuuuggggaaaccaaaggaaauuccgccccgcugaucauuagagagcccuucaucgcuugcggcccuaaggaauguaaacauuuugcccucacacacuacgcugcccagcccgggggauauuacaacggcacccgggaggaccgcaauaagcugagacaucugaucagcgugaagcucggcaaaauuccuacaguugagaacucuaucuuccacauggcggccugguccgggagcgcuugccaugauggacgggaauggaccuauauuggcguggacgggcccgauucuaaugcccugcuuaagaucaaauacggagaggcuuacacggacacauaucacuccuacgccaacaauauucugcgcacccaggaaagcgcguguaacugcaucggcgggaauuguuaucucaugauuacagauggauccgccucuggcaucagcgagugcagauuucugaagauccgggagggccgcauuaucaaagaaauuuucccgaccgggagagucgagcacaccgaagaguguacaugcggauuugcuuccaacaagacgaucgaaugugccugccgggacaauagcuacaccgcuaagcgcccuuucgugaaacuuaacguugagacagauaccgccgagauuagacugaugugcacagaaaccuaucucgacacgccccggccugaugacggcucuaucacagggcccugugaguccaauggagauaagggcagcgggggaaucaaaggcggcuuugugcaucaacgcauggccucuaagauugggagaugguacagccggaccauguccaaaaccaagagaaugggaaugggccuguaugucaaauacgacggggaccccuggacagauucugacgcucuggcgcucagcggagugaugguguccauggaggaaccuggcugguacagcuucggguuugaaaucaaggauaagaaaugcgacgucccguguauuggcaucgagaugguucacgauggaggcaagaaaaccuggcauucugccgcuacagccauuuauugccugaugggguccggacagcuucugugggacacggugaccggcguggauauggcccucuga

SEQ ID NO: 212040 - RNA, 1401 nt, Artificial Sequence
  derived and/or modified sequence opt5 from neuraminidase__InfluenzaB__AFJ80187
augcugcccagcaccauccagacacucacgcuguuccuuaccuccggcggggugcugcucucucuguacgucagcgccucccuuucuuaucugcucuacagcggcauucugcugaaguuuuccccuacagagaucaccgcuccgacaaugccccucaacugcgccaaugcgucuaacuuccaagcuguuaauagaagcgccaccaaaggagugacacugcuucugccugaacccgaguggaccuauccucggcucuccugucccgggagcacguuucagaaggcccugcuuauuucuccucaccgcuucggagaaaccaaaggcaacuccgcuccgcugaucauuagagagcccuuuaucgccugcgggccuaaggaauguaaacauuucgcucucacacacuacgccgcgcagcccggaggcuauuacaauggcacccgggaggaccgcaacaagcugagacaucugaucagcgugaagcucgggaaaauuccuacagucgaaaauucuaucuuucacauggccgcuugguccggaagcgccugccaugauggccgggaauggaccuauauugggguggacggacccgauucuaacgcucugcuuaagaucaaauacggcgaggccuacacggacacauaucacuccuacgcgaauaacauucugcgcacccaggaaagcgccuguaauugcaucgggggagauuguuaucucaugauuacagacggcuccgcuucuggcaucagcgagugcagauuccugaagauccgggaggggcgcauuaucaaagaaauuuuuccgaccggaagaguugagcacaccgaagaguguacaugcggcuucgccuccaacaagacgaucgaaugugcuugccgggauaauagcuacaccgccaagcgcccuuuugugaaacuuaacgucgagacagacaccgccgagauuagacugaugugcacagaaaccuaucucgauacgccccggccugacgaugggucuaucacaggacccugugaguccaauggcgacaaggggagcggaggcaucaaaggcggguucgugcaucaacgcauggcuucuaagauuggaagaugguacagccggaccauguccaaaaccaagagaaugggcauggggcuguauguuaaauacgauggagaccccuggaucgacucugaugcgcugacacucagcggcgugauggucuccauggaggagccugggugguacagcuuuggcuucgaaauuaaggacaagaaaugcgaugugccguguaucggaauugagauggugcacgacggcgggaagaaaaccuggcauucugccgcuacagccaucuauugccugaugggauccggccagcuucugugggauacggucaccgggguugacauggcccucuga

SEQ ID NO: 212041 - RNA, 1401 nt, Artificial Sequence; identical to SEQ ID NO: 212036
  derived and/or modified sequence opt5 from neuraminidase__InfluenzaB__AFJ80198

SEQ ID NO: 212042 - RNA, 1401 nt, Artificial Sequence; identical to SEQ ID NO: 211664
  derived and/or modified sequence opt5 from neuraminidase__InfluenzaB__AFJ80220

SEQ ID NO: 212043 - RNA, 1401 nt, Artificial Sequence
  derived and/or modified sequence opt5 from neuraminidase__InfluenzaB__AFJ80231
augcugcccagcaccauccagacacucacgcuguuccuuaccuccggcggggugcugcucucucuguacgucagcgccucccuuucuuaucugcucuacagcggcauucugcugaaguuuucccucacagagaucaccgcuccuacaaugccgcugaacugcgccaaugcgucuaacguucaagcugugaauagaagcgccaccaaaggagugacacuuuuccugcccgaaccugaguggaccuauccccggcucuccuguccugggagcacguuucagaaggcccugcuuauuucuccccaccgcuucggagaaaccaaaggcaacuccgcuccucugaucauuagagagccguuuaucgccugcgggcccaaggaauguaaacauuucgcucucacacacuacgccgcgcagccuggaggcuauuacaauggcacccgggaggaccgcaacaagcugagacaucugaucagcgucgagcucgggaagauucccacaguggaaaauucuaucuuucacauggccgcuugguccggaagcgccugccaugauggcaaagaguggaccuauauugggguugacggaccugauucuaacgcucugcuuaagaucaaauacggcgaagccuacacggacacauaucacuccuacgcgaauaacauucugcggacccaggagagcgccuguaauugcaucgggggagauuguuaucucaugauuacagacggcuccgcuucuggcaucagcgagugccgcuuccugaagaucagagaagggcggauuaucaaagagauuuuucccaccggacgcguggaacacaccgaggaauguacaugcggcuucgccuccaacaagacgaucgagugugcuugcagagauaauagcuacaccgccaagcggccguuugucaaacuuaacguggagacagacaccgccgaaauucgccugaugugcacagagaccuaucucgauacgccuagacccgacgaugggucuaucacaggaccuugugaauccaauggcgacaaggggagcggaggcaucaaaggcggguucguucaucaacggauggcuucuaagauuggacgcugguacagcagaaccauguccaaaaccaagcggaugggcauggggcuguaugugaaauacgauggagaccccuggaucgacucugaugcgcugacacucagcggcgucaugguguccauggaggaacccgggugguacagcuuuggcuucgagauuaaggacaagaaaugcgaugugccuuguaucggaauugagaugguccacgacggcgggaagaaaaccuggcauucugccgcuacagccaucuauugccugaugggauccggccagcuucugugggauacgguuaccgggguggacauggcccucuga

SEQ ID NO: 212044 - RNA, 1401 nt, Artificial Sequence
  derived and/or modified sequence opt5 from neuraminidase__InfluenzaB__AFJ80242
augcugcccagcaccauccagacacucacgcuguuccuuaccuccggcggggugcugcucucucuguacgucagcgcccuucuguccuaucuccuguacucugacauucugcucaaguuuagcccuacaaaaguuaucgcuccgaccaugucccuggauugcgccaacgcgucuaaugugcaagcugugaaccacagcgccacagaggaaaugaccuuccuucugcccgagccugaauggacauaucccagacucuccugucagggaagcaccuuucagaaggcccugcuuauuucuccucaucgguucggcgaggcuaaaggaaauuccgcuccccugaucauucgcgaaccuuuuaucgccugcgggccgaaggaguguaaacacuucgcccucacgcauuacgcggcccagcccggcggguauuacaacggaaccagagaggaccggaauaagcugcgccaccugaucagcgucaaccucggcaagauuccuacaguggaaaauucuaucuuucauauggcugccugguccggcagcgcuugccacgaugggagagaguggaccuauauuggaguugacggccccgauucuaacgcccugaucaaaauuaaguacggggaagcguacacagacaccuaucacuccuacgccaauaacauccuucggacgcaagagagcgcuuguaauugcauuggaggcgauuguuaucugaugaucacagacggguccgccucuggaaucagccgcugcagauuccucaaaauucgggagggccgcaucauuaaggaaaucuuuccuaccggcagaguggagcauacagaagaguguaccugcggguucgcuuccaacaaaaccauugaaugugccugccgggauaauagcuacacagccaagcgccccuuugucaagcugaacguggagacggacaccgcugagaucagacuuaugugcacagaaaccuaucuggauacaccgcggccugacgauggaucuaucaccggccccugugaguccaauggggacaaaggaaacggcgggauuaagggaggcuucguucaccagcgcauggcgagcagaaucggccggugguacucuagaacgaugagcaaaacaaagcgcauggggauggaacucuaugugaaauacgacggagauccuuggaccgacuccgaugcccuggcucccucuggcgucauggugagcauggaggaacccgggugguacuccuuuggauucgagauuaaggacaaaaagugcgaugugccuuguaucggcauugagaugguccaugacgggggcaagaccacauggcacagcgccgccaccgcuaucuauugccugaugggaucuggccagcuccugugggauacaguuacggggguggacauggcccuuuga

SEQ ID NO: 212045 - RNA, 1401 nt, Artificial Sequence
  derived and/or modified sequence opt5 from neuraminidase__InfluenzaB__AFJ80660
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggacgggaauggaccuauauuggcguugacgggcccgauucuaaugcucugcuuaagaucaaauacggagaggccuacacggacacauaucacuccuacgcgaacaauauucugcgcacccaggaaagcgccuguaacugcaucggcggggauuguuaucucaugauuacagacggauccgcuucuggcaucagcgagugcagauuucugaagauccgggagggccgcauuaucaaagaaauuuucccgaccgggagaguggagcacaccgaagaguguacaugcggauuugccuccaauaagacgaucgaaugugcuugccgggauaacagcuacaccgccaagcgcccuuucgucaaacuuaauguggagacagacaccgccgagauuagacugaugugcacagaaaccuaucucgauacgccccggccugacgauggcucuaucacagggcccugugaguccaacggagacaagggcagcgggggaaucaaaggcggcuuuguucaucaacgcaugaccucuaagauugggagaugguacagccggaccauguccaaaacaaagagaaugggaaugggccuguaugugaaauacgacggggaucccuggaccgacucugaugcucuggcgcucagcggagucaugguguccauggaggaaccuggcugguacagcuucggguuugaaaucaaggacaagaaaugcgaugugccguguauuggcaucgagaugguccacgacggaggcaagaaaacauggcauucugccgcuacggccauuuauugccugaugggguccggacagcuucugugggauaccguuacaggcguggacauggcccucuga

SEQ ID NO: 212046 - RNA, 1401 nt, Artificial Sequence; identical to SEQ ID NO: 212043
  derived and/or modified sequence opt5 from neuraminidase__InfluenzaB__AFJ80671

SEQ ID NO: 212047 - RNA, 1401 nt, Artificial Sequence; identical to SEQ ID NO: 212043
  derived and/or modified sequence opt5 from neuraminidase__InfluenzaB__AFJ80682

SEQ ID NO: 212048 - RNA, 1401 nt, Artificial Sequence
  derived and/or modified sequence opt5 from neuraminidase__InfluenzaB__AFJ80693
augcugcccagcaccauccagacacucacgcuguuccuuaccuccggcggggugcugcucucucuguacgucagcgccucccuuucuuaucugcucuacagcggcauucugcugaaguuuuccccuacagagaucaccgcuccgacaaugccccucaacugcgccaaugcgucuaacguucaagcugugaauagaagcgccaccaaaggagugacacugcuucugccugaacccgaguggaccuauccucggcucuccugucccgggagcacguuccagaaggcccugcuuauuucuccucaccgcuuuggagaaaccaaaggcaacuccgcuccgcugaucauuagagagcccuucaucgccugcgggccuaaggaauguaaacauuuugcucucacacacuacgccgcgcagcccggaggcuauuacaauggcacccgggaggaccgcaacaagcugagacaucugaucagcgucaagcucgggaaaauuccuacaguggaaaauucuaucuuccacauggccgcuugguccggaagcgccugccaugauggccgggaauggaccuauauugggguugacggacccgauucuaacgcucugcuuaagaucaaauacggcgaggccuacacggacacauaucacuccuacgcgaauaacauucugcgcacccaggaaagcgccuguaauugcaucgggggagauuguuaucucaugauuacagacggcuccgcuucuggcaucagcgagugcagauuucugaagauccgggaggggcgcauuaucaaagaaauuuucccgaccggaagaguggagcacaccgaagaguguacaugcggcuuugccuccaacaagacgaucgaaugugcuugccgggauaauagcuacaccgccaagcgcccuuucgucaaacuuaacguggagacagacaccgccgagauuagacugaugugcacagaaaccuaucucgauacgccccggccugacgaugggucuaucacaggacccugugagucccauggcgacaaggggagcggaggcaucaaaggcggguuuguucaccaacgcauggcuucuaagauuggaagaugguacagccggaccauguccaaaaccaagagaaugggcauggggcuguaugugaaauacgauggagaccccuggaucgacucuggcgcgcugacacucagcggggucaugguguccauggaggagccuggcugguacagcuucggauuugaaauuaaggauaagaaaugcgacgugccguguaucggcauugagaugguccaugaugggggaaagaaaaccuggcacucugccgcuacagccaucuauugccugaugggcuccgggcagcuucugugggacacgguuaccggaguggauauggcccucuga

SEQ ID NO: 212049 - RNA, 1401 nt, Artificial Sequence
  derived and/or modified sequence opt5 from neuraminidase__InfluenzaB__AFJ80726
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaaggaauguaaacauuuugcucucacacacuacgccgcgcagccugggggauauuacaacggcacccgggaggaccgcaauaagcugagacaucugaucagcgucaagcucggcaaaauucccacaguggagaacucuaucuuccacauggccgcuugguccgggagcgccugccaugauggacgggaauggaccuauauuggcguugacgggccugauucuaaugcucugcuuaagaucaaauacggagaggccuacacggacacauaucacuccuacgcgaagaacauucugcgcacccaagaaagcgccuguaauugcaucggcggggauuguuaucucaugauuacagacggauccgcuucuggcaucagcgagugcagauuucugaaaauccgggagggccgcauuaucaaggaaauuuuccccaccgggagagugaagcacaccgaggaauguacaugcggauuugccuccaacaaaacgaucgagugugcuugccgggauaauagcuacaccgccaagcgcccguucgucaaacuuaacguggaaacagacaccgccgagauuagacugaugugcacagagaccuaucucgauacgccucggcccaaugacggcucuaucacagggccuugugaauccaacggagaucgcggcgggggaggcaucaagggcggguuuguucaucagagaauggcuagcaaaauuggacggugguacucuagaaccaugagcaagaccaaacgcaugggcauggggcuguaugugaaguacgacggagaccccuggacagauuccgaggcgcuggcccucucuggcgucauggugcccauggaggaaccugggugguacagcuucggcuuugaaaucaaggacaaaaagugcgaugugccguguauuggaaucgagaugguccacgacggcgggaaaaccacauggcauuccgcugccacggccauuuauugccugaugggaagcggccagcuucugugggauaccguuacagggguggacauggcucucuga

SEQ ID NO: 212050 - RNA, 1401 nt, Artificial Sequence
  derived and/or modified sequence opt5 from neuraminidase__InfluenzaB__AFJ80737
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggacgggaauggacauauaucggcguugacgggccugauucuaaugcucugcuuaagauuaaauacggagaggccuacaccgacacguaucacuccuacgcgaagaacauccugcgcacacaagaaagcgccuguaauugcauuagaggcgauuguuaucucaugaucaccgacgggcccgcuuccggaaucucugagugccgguuucugaaaauucgcgagggcagaaucauuaaggaaaucuucccgacaggccgggugaagcacaccgaggaauguaccugcggguuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggaagcaucaccggccccugugaaucuaacggggauaagggauccggcgggauuaaaggaggcuuuguucaucagagaauggcuagcaagaucggccggugguacucuagaacaaugagcaaaaccaagcgcauggggaugggacuguaugugaaguacgacggcgaccccuggaccgauuccgaggcgcuggcccucucuggggucauggugagcauggaggaaccuggaugguacuccuucggcuuugaaauuaaagacaagaaaugcgaugugccguguaucgggauugagaugguccacgacggcggaaagacaaccuggcauagcgcugccacagccaucuauugccugaugggcucugggcagcuucugugggauacgguuaccggaguggacauggcucucuga

SEQ ID NO: 212051 - RNA, 1401 nt, Artificial Sequence; identical to SEQ ID NO: 211692
  derived and/or modified sequence opt5 from neuraminidase__InfluenzaB__AFJ80759

SEQ ID NO: 212052 - RNA, 1401 nt, Artificial Sequence
  derived and/or modified sequence opt5 from neuraminidase__InfluenzaB__AFJ80770
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccgggaggaccgcaacaaacugagacaucugaucagcgucaagcucggcaagauucccacaguggaaaauucuaucuuccacauggccgcuugguccgggagcgccugccaugauggacgggaauggaccuauauuggcguugacgggccugauucuaacgcucugcuuaaaaucaaguacggagaggccuacacggacacauaucacuccuacgcgaaaaauauucugcgcacccaagaaagcgccuguaacugcaucggcggggauuguuaucucaugauuacagacggacccgcuuccggcaucucugagugcagauuucugaagauccgggagggccgcauuaucaaagaaauuuucccgaccgggagagugaagcacaccgaggaauguacaugcggauuugccagcaauaagacgaucgagugugcuugccgggauaacuccuacaccgccaaacgcccuuucgucaaacuugacguggaaacagauaccgccgagauuagacugaugugcacagagaccuaucucgacacgccccggccuaaugauggcagcaucacagggcccugugaaucuaacggagacaagggcuccgggggaaucaagggcggcuuuguucaucagcgcauggcuagcaaaauugggagaugguacucucggacccugagcaagaccaaaagaaugggaaugggccuguaugugaaguacgacggggaucccuggacagacuccgaggcgcucgcccugucuggagucauggugagcauggaggagccuggcugguacuccuucggguuugaaaucaaggauaaaaagugcgacgugccguguauuggcaucgagaugguccacgauggaggcaaaaccacauggcauagcgcugccacggccauuuauugccuuauggggucuggacagcugcucugggacaccguuacaggcguggauauggcucuguga

SEQ ID NO: 212053 - RNA, 1401 nt, Artificial Sequence; identical to SEQ ID NO: 211692
  derived and/or modified sequence opt5 from neuraminidase__InfluenzaB__AFJ80785

SEQ ID NO: 212054 - RNA, 1401 nt, Artificial Sequence; identical to SEQ ID NO: 211692
  derived and/or modified sequence opt5 from neuraminidase__InfluenzaB__AFJ80796

SEQ ID NO: 212055 - RNA, 1401 nt, Artificial Sequence
  derived and/or modified sequence opt5 from neuraminidase__InfluenzaB__AFJ80807
augcugcccagcaccauccagacacucacgcuguuccuuaccuccggcggggugcugcucucucuguacgucagcguuucccuuucuuaucugcucuacagcgacauucugcugaaguuuccuuccacagagaucaccgccccgacaaugccccucgauugcgcuaacgccucuaaugugcaagcggugaacagaagcgcuaccaaaggagucacacugcuucugccugaacccgaguggaccuauccucggcucuccugucccggcagcacguuccagaaggcccugcuuauuucuccucaccgcuuuggggaaaccaaaggaaauuccgccccgcugaucauuagagagcccuucaucgcuugcggcccuaaggaauguaaacauuuugcccucacacacuacgcugcccagcccgggggauauuacaacggcacccggggcgaccgcaauaagcugagacaucugaucagcgugaagcucgggaaaauuccuacaguugagaacucuaucuuccacauggcggccugguccggaagcgcuugccaugauggcaaggaguggaccuauauugggguggacggacccgauaauaacgcccugcuuaaaaucaaguacggcgaggcuuacacggacacauaucacucuuacgccaauaacauucugcggacccaggaguccgcguguaauugcaucgggggaaacuguuaucucaugauuacagauggcagcgccuccggcgucucugaaugccgcuuucugaaaaucagagaggggcggaucauuaaggagaucuucccgaccggacgcauuaagcacaccgaagaguguacaugcggcuuugcuagcaauaaaacgaucgaaugugccugcagagacaacuccuacaccgcuaagcggccuuucgugaaacuuaauguugagacagauaccgccgaaauucgccugaugugcacagagaccuaucucgacacgcccagaccugaugacgggagcaucacaggacccugugagucuaacggcgauaagggguccggaggcaucaaaggcggguuugugcaucaacggauggccagcaagauuggacgcugguacucuagaaccaugagcaaaaccaagcggaugggcauggggcuguaugucaaguacgacggagaccccugggcugauuccgacgcgcuggccuucucuggcgugauggugagcauggaagaaccugggugguacuccuuuggcuucgaaaucaaagauaagaaaugcgacgucccguguauuggaaucgagaugguucacgauggcgggaaggaaacauggcauagcgcugccaccgccauuuauugccucaugggaucuggccagcugcuuugggacacagugacgggggugaacauggcucuguga

SEQ ID NO: 212056 - RNA, 1401 nt, Artificial Sequence; identical to SEQ ID NO: 211692
  derived and/or modified sequence opt5 from neuraminidase__InfluenzaB__AFJ80818

SEQ ID NO: 212057 - RNA, 1401 nt, Artificial Sequence; identical to SEQ ID NO: 211692
  derived and/or modified sequence opt5 from neuraminidase__InfluenzaB__AFJ80829

SEQ ID NO: 212058 - RNA, 1401 nt, Artificial Sequence; identical to SEQ ID NO: 212029
  derived and/or modified sequence opt5 from neuraminidase__InfluenzaB__AFJ80840

SEQ ID NO: 212059 - RNA, 1401 nt, Artificial Sequence; identical to SEQ ID NO: 212029
  derived and/or modified sequence opt5 from neuraminidase__InfluenzaB__AFJ80851

SEQ ID NO: 212060 - RNA, 1401 nt, Artificial Sequence
  derived and/or modified sequence opt5 from neuraminidase__InfluenzaB__AFJ80862
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcuaugaacagaagcgccaccaaaggagugacacugcuucugccugaaaccgaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaaggaauguaaacauuuugcucucacccacuacgccgcgcagccugggggauauuacaacggcacacggggcgaccgcaauaagcugagacaucugaucagcgugaagcucgggaaaauucccaccgucgagaacucuaucuuccacauggccgcuugguccggaagcgccugccaugauggcaaggaguggacguauauugggguggacggaccugauaauaacgcucugcuuaaaaucaaguacggcgaagccuacacagacaccuaucacucuuacgcgaauaacauucugcggacacaggaguccgccuguaauugcaucgggggaaacuguuaucucaugauuaccgauggcagcgcuuccggcguuucugaaugccgcuuucugaaaaucagagaggggcggaucauuaaggagaucuuccccaccggacgcauuaagcacacagaagaguguacgugcggcuuugccagcaauaaaaccaucgaaugugcuugcagagacaacuccuacacagccaagcggccguucgugaaacuuaaugucgagaccgauacagccgaaauucgccugaugugcaccgagacguaucucgacacaccuagacccgaugacgggagcaucaccggaccuugugagucuaacggcgauaagggguccggaggcaucaaaggcggguuugugcaucaacggauggcuagcaagauuggacgcugguacucuagaaccaugagcaaaacagaacggaugggcauggggcuguauguuaaguacgacggagaccccugggcggauuccgacgcccugaccuucucuggcgugauggucagcauggaggaacccgggugguacuccuuuggcuucgagaucaaggauaaaaagugcgacgugccuuguauuggaaucgaaauggugcacgauggcgggaaagagacauggcauagcgcugccacggccauuuauugccucaugggaucuggccagcugcuuugggacaccgucacagggguuaacauggcucuguga

SEQ ID NO: 212061 - RNA, 1401 nt, Artificial Sequence
  derived and/or modified sequence opt5 from neuraminidase__InfluenzaB__AFJ80873
augcugcccagcaccauccagacacucacgcuguuccuuaccuccggcggggugcugcucucucuguacgucagcgccucccuuucucaucugcucuauagcgggauucugcugaaguuuccuuccacagagaucaccgcuccgacaaugccccucgacugcgccaacgcgucuaauguucaagcugugaacagaagcgccaccaaaggcgugacacugcuuccucccgaaccugaguggaccuacccccggcuguccuguccugggagcacguuccagaaggcccuccugauuucuccgcaccgcuuuggagaaaccaaaggcaauuccgcuccccuuaucauuagagagccuuucaucgccugcgggcccaaggaauguaaacacuuugcucugacacauuaugccgcgcagccuggaggcuacuauaacggcacccggggagaucgcaauaagcucagacaccugaucagcgucaagcugggaaaaauucccacaguggagaacucuaucuuccauauggccgcuugguccggcagcgccugccacgacgggaaggaguggaccuacauuggaguugauggcccggacaauaacgcucuccugaaaaucaaguauggggaagccuacacggauacauaccacucuuaugcgaauaacauucuucggacccaggaguccgccuguaauugcaucggaggcaacuguuaccugaugauuacagacggcagcgcuuccggggugucugaaugccgcuuucucaaaaucagagagggacggaucauuaaggagaucuucccuaccggccgcauuaagcauaccgaagaguguacaugcggguuugccagcaauaaaacgaucgaaugugcuugcagagauaacuccuauaccgccaagcggcccuucgucaaacugaauguggagacagacaccgccgaaauucgccuuaugugcacagagaccuaccuggauacgccuagacccgacgauggaagcaucacaggccccugugagucuaacggggacaagggauccggcggcaucaaagggggauuuguucaccaacggauggcuagcaagauuggccgcugguauucuagaaccaugagcaaaaccgaacggauggggaugggacucuacgugaaguaugauggcgacccuugggcggacuccgaugcccugacauucucuggggucauggugagcauggaggaaccgggcugguacuccuuuggauucgagaucaaggacaaaaagugcgaugugcccuguauuggcaucgaaaugguccaugacgggggaaaagagaccuggcacagcgcugccacagccauuuacugccugaugggcucugggcagcuccugugggauacgguuaccggagugaacauggcucuuuga

SEQ ID NO: 212062 - RNA, 1401 nt, Artificial Sequence
  derived and/or modified sequence opt5 from neuraminidase__InfluenzaB__AFJ80884
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucuaaaugccgcuuucugaagaucagagaagggcggaucauuaaggagaucuucccgaccggacgcauuaaacacaccgaggaauguacaugcggcuuugccagcaauaagacgaucgagugugcuugcagagacaacuccuacaccgccaaacggccuuucgucaaacuuaauguggaaacagauaccgccgagauucgccugaugugcacagaaaccuaucucgacacgcccagaccugaugacgggagcaucacaggacccugugagucuaacggcgauaagggguccggaggcaucaagggcggguuuguucaucaacggauggcuagcaaaauuggacgcugguacucuagaaccaugagcaagaccgagcggaugggcauggggcuguaugugaaguacgacggagaccccugggcggauuccgacgcccugacauucucuggcgucauggugagcauggaggaaccugggugguacuccuuuggcuucgaaaucaaagauaagaaaugcgacgugccguguauuggaaucgagaugguccacgauggcgggaaggaaaccuggcauagcgcugccacagccauuuauugccucaugggaucuggccagcugcuuugggacacgguuaccggggugaacauggcucuguga

SEQ ID NO: 212063 - RNA, 1401 nt, Artificial Sequence; identical to SEQ ID NO: 212028
  derived and/or modified sequence opt5 from neuraminidase__InfluenzaB__AFJ80895

SEQ ID NO: 212064 - RNA, 1401 nt, Artificial Sequence
  derived and/or modified sequence opt5 from neuraminidase__InfluenzaB__AFJ80917
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaauguaccugcagagacaacuccuacacagcuaagcggccuuucgucaaacuuaauguggagaccgauacagccgaaauucgccugaugugcaccgagacguaucucgacacacccagaccugaugacgggagcaucaccggacccugugagucuaacggcgauaagggguccggaggcaucaaaggcggguuuguucaucaacggauggccagcaagauuggacgcugguacucuagaaccaugagcaaaacagaacggaugggcauggggcuguaugugaaguacgacggagaccccugggcugauuccgacgcgcugaccuucucuggcgucauggugagcauggaggaaccugggugguacuccuuuggcuucgagaucaaggauaaaaagugcgacgugccguguauuggaaucgaaaugguccacgauggcgggaaagagacauggcauagcgccgcuacggccauuuauugccucaugggaucuggccagcugcuuugggacaccguuacaggggugaacauggcccuguga

SEQ ID NO: 212065 - RNA, 1401 nt, Artificial Sequence
  derived and/or modified sequence opt5 from neuraminidase__InfluenzaB__AFJ80928
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcgaaccuaaggaguguaaacauuuugcucucacacacuacgccgcgcagcccggcggguauuacaacggaacccggggcgaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauaauaacgcucugcuuaaaaucaaguacggagaggccuacacggacacauaucacucuuacgcgaauaacauucugcggacccaggaauccgccuguaauugcaucggcgggaacuguuaucucaugauuacagauggaagcgcuuccggcgugucugagugccgcuuucugaaaaucagagagggccggaucauuaaggaaaucuucccgaccgggcgcauuaagcacaccgaggaauguacaugcggauuugccagcaauaaaacgaucgagugugcuugcagagacaacuccuacaccgccaagcggccuuucgucaaacuuaauguggaaacagauaccgccgagauucgccugaugugcacagagaccuaucucgacacgcccagaccugaugacggcagcaucacagggcccugugaaucuaacggagauaagggcuccgggggaaucaaaggcggcuuuguucaucaacggauggcuagcaagauugggcgcugguacucuagaaccaugagcaaaaccgagcggaugggaaugggccuguaugugaaguacgacggggaccccugggcggauuccgacgcccugacauucucuggagucauggugagcauggaggaaccuggcugguacuccuuuggguucgaaaucaaggauaaaaagugcgacgugccguguauuggcaucgagaugguccacgauggaggcaaagagaccuggcauagcgcugccacagccauuuauugccucauggggucuggacagcugcuuugggacacgguuaccggcgugaacauggcucuguga

SEQ ID NO: 212066 - RNA, 1401 nt, Artificial Sequence
  derived and/or modified sequence opt5 from neuraminidase__InfluenzaB__AFJ80939
augcugcccagcaccauccagacacucacgcuguuccuuaccuccggcggggugcugcucucucuguacgucagcgccucccuuucuuaucugcucuacagcgacauucugcugaaguuuccuccgacagagguuaccgcucccacaaugccucucgauugcgccaacgcguccaaugugcaagcugugaacagaucugccaccaaaggagucacacugcuucugcccgaaccugaguggaccuauccccggcucagcuguccuggcuccacguuccagaaggcccugcuuaucagcccgcaccgcuuuggggaaaccaaaggaaauucugcuccccugauuaucagagagccuuucauugccugcggccccaaggaauguaaacauuuugcucucacacacuacgccgcgcagccugggggauauuacaacggcacccggggcgaccgcaauaagcugagacaucugaucuccgugaagcucgggaaaauccccacaguugagaacagcauuuuccacauggccgcuuggucuggauccgccugccaugauggcaaggaguggaccuauaucgggguggacggaccggauaauaacgcucugcuuaaaauuaaguacggcgaagccuacacggacacauaucacagcuacgcgaauaacauccugcggacccaggagucugccuguaauugcauugggggaaacuguuaucucaugaucacagauggcuccgcuagcggcgucuccgaaugccgcuuucugaaaauuagagaggggcggaucaucaaggagauuuucccuaccggacgcaucaagcacaccgaagaguguacaugcggcuuugccucuaauaaaacgauugaaugugcuugcagagacaacagcuacaccgccaagcggcccuucgugaaacuuaauguugagacagauaccgccgaaauccgccugaugugcacagagaccuaucucgacacgccuagacccgaugacggguccauuacaggacccugugagagcaacggcgauaaggggucuggaggcaucaaaggcggguuugugcaucaacggauggcuuccaagaucggacgcugguacagcagaaccaugucuaaaaccgaacggaugggcauggggcuguaugucaaguacgacggagacccuugggcggauagcgacgcccugacauucuccggcgugauggugucuauggaggaaccggggugguacagcuuuggcuucgagauuaaggauaaaaagugcgacguccccuguaucggaauugaaaugguucacgauggcgggaaagagaccuggcauuccgcugccacagccaucuauugccucaugggaagcggccagcugcuuugggacacggugaccggggugaacauggcucuguga

SEQ ID NO: 212067 - RNA, 1401 nt, Artificial Sequence
  derived and/or modified sequence opt5 from neuraminidase__InfluenzaB__AFJ80950
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcaacgggggaauuaaaggcggcuuuguucaucagcggauggcguccaagaucgggcgcugguacagcagaacaaugucuaaaaccaagcggaugggaaugggccuguaugugaaguacgacggggaucccuggaccgacagcgaggcccuggcucucuccggagucauggugucuauggaggaaccuggcugguacagcuucggguuugaaauuaaagauaagaaaugcgacgugccguguaucggcauugagaugguccacgauggaggcaagacaaccuggcauuccgccgccacagcuaucuauugccugauggggagcggacagcuucugugggacacgguuaccggcguggauauggcccucuga

SEQ ID NO: 212068 - RNA, 1401 nt, Artificial Sequence; identical to SEQ ID NO: 212029
  derived and/or modified sequence opt5 from neuraminidase__InfluenzaB__AFJ80961

SEQ ID NO: 212069 - RNA, 1401 nt, Artificial Sequence; identical to SEQ ID NO: 211812
  derived and/or modified sequence opt5 from neuraminidase__InfluenzaB__AFJ80972

SEQ ID NO: 212070 - RNA, 1401 nt, Artificial Sequence; identical to SEQ ID NO: 211812
  derived and/or modified sequence opt5 from neuraminidase__InfluenzaB__AFJ80983

SEQ ID NO: 212071 - RNA, 1401 nt, Artificial Sequence; identical to SEQ ID NO: 211767
  derived and/or modified sequence opt5 from neuraminidase__InfluenzaB__AFJ80994

SEQ ID NO: 212072 - RNA, 1401 nt, Artificial Sequence; identical to SEQ ID NO: 211812
  derived and/or modified sequence opt5 from neuraminidase__InfluenzaB__AFJ81005

SEQ ID NO: 212073 - RNA, 1401 nt, Artificial Sequence; identical to SEQ ID NO: 211812
  derived and/or modified sequence opt5 from neuraminidase__InfluenzaB__AFJ84364

SEQ ID NO: 212074 - RNA, 1401 nt, Artificial Sequence
  derived and/or modified sequence opt5 from neuraminidase__InfluenzaB__AFJ90399
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgcccaugccucucgauugcgccaacgcgucuaauguucaagcugugaacagaagcgccacaaaaggagugacccugcuucugcccgaaccugaguggacauauccccggcucuccuguccuggcagcaccuuccagcgcgcccugcuuauuucuccgcacagauuuggggaaacgaagggaaauuccgcuccccugaucauucgggagccuuucaucgccugcggcccccgcgaauguaaacauuuugcucucacccacuacgccgcgcagccugggggauauuacaacggcacaagaggcgaccggaauaagcugcgccaucugaucagcgucaaacucgggaagauucccaccguggagaacucuaucuuccacauggccgcuugguccggaagcgccugccaugauggcaaggaguggacauauauugggguugacggaccggauaauaacgcucugcuuaaaaucaaguacggcgaagccuacaccgacacguaucacucuuacgcgaauaacauucugagaacacaggaguccgccuguaauugcaucgggggaaacuguuaucucaugauuaccgauggcagcgcuuccggcgugucugaaugccgguuucugaaaauccgcgaggggagaaucauuaaggagaucuucccuacaggacggauuaaacacaccgaagaguguaccugcggcuuugccagcaauaagacaaucgaaugugcuugccgcgacaacuccuacacggccaagagacccuucgucaaacuuaauguggagaccgauacagccgaaauucggcugaugugcaccgagacauaucucgacaccccucgccccgaugacgggagcaucacgggacccugugagucuaacggcgauaagggguccggaggcaucaaaggcggguuuguucaucaaagaaugacaagcaagauuggacggugguacucuagaaccaugagcaaaaccgaacgcaugggcauggggcuguaugugaaguacgacggagacccuugggcugauuccgacgcgcugacauucucuggcgucauggugagcauggaggaaccggggugguacuccuuuggcuucgagaucaaagauaagaagugcgacgugcccuguauuggaaucgaaaugguccacgauggcgggaaagagaccuggcauagcgccgcuacagccauuuauugccucaugggaucuggccagcugcuuugggacacgguuaccggggugaacauggcccuguga

SEQ ID NO: 212075 - RNA, 1401 nt, Artificial Sequence
  derived and/or modified sequence opt5 from neuraminidase__InfluenzaB__AFJ90410
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccaagccugaauggaccuauccccggcucuccuguccuggcagcacauuccagaaagcucugcuuaucucuccccaccgcuuuggggagaccaagggaaauuccgccccucugauuaucagagaaccguucaucgcuugcggccccacggaguguaaacauuuugcccucacccacuacgcggcccagccugggggauauuacaacggcacacgggaagaccgcaauaaccugagacaucugauuagcgucaagcucggcaagauccccaccguggaaaauucuauuuuccacauggcugccugguccgggagcgcuugccaugauggaaaagaguggacauauaucggcguugacgggccugauucuaacgcccugcuuaagauuaaauacggagaggcguacaccgacacguaucacuccuacgccaagaauauccugcggacacaagagagcgcuuguaacugcauuggcggggauuguuaucucaugaucaccgacggacccgccuccggcaucucugaaugccgcuuucugaaaauuagagagggccggaucauuaaggagaucuucccgacagggcgcgugaagcacaccgaagaguguaccugcggauuugcuagcaauaaaacaauugaaugugccugcagagauaacuccuacacggccaagcggccuuucgucaaacuuaauguggagaccgacacagcugaaauccgccugaugugcaccgagacauaucucgauacccccagaccuaacgacggcagcaucacggggcccugugagucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaagcccuggcucucucuggagucauggugagcauggaggaaccuggcugguacuccuucggguuugagauuaaagauaagaaaugcgacgugccguguaucggcauugaaaugguccacgauggaggcaagacaaccuggcauagcgccgccacagcuaucuauugccugauggggucuggacagcuucugugggacacgguuaccggcguggauauggcccucuga

SEQ ID NO: 212076 - RNA, 1401 nt, Artificial Sequence
  derived and/or modified sequence opt5 from neuraminidase__InfluenzaB__AFJ90432
augcugcccagcaccauccagacacucacgcuguuccuuaccuccggcggggugcugcucucucuguacgucagcacaucccuuucuuaucugcucuacagcgacauucugcugaaguuuucccaaaccgagaucacagccccuauuaugccgcucgauugcgcuaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccuguaugugaaguacgacggggaucccuggacagacuccgaggcgcuggcccucucuggagucauggugagcauggaggaaccuggcugguacuccuucggguuugaaauuaaagauaagaaaugcgacgugccguguaucggcauugagaugguccacgauggaggcaagaccacauggcauagcgcugccacggccaucuauugccugauggggucuggacagcuucugugggacaccguuacaggcguggauauggcucucuga

SEQ ID NO: 212077 - RNA, 1401 nt, Artificial Sequence; identical to SEQ ID NO: 211996
  derived and/or modified sequence opt5 from neuraminidase__InfluenzaB__AFJ90443

SEQ ID NO: 212078 - RNA, 1401 nt, Artificial Sequence
  derived and/or modified sequence opt5 from neuraminidase__InfluenzaB__AFJ90454
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuguuccgcucgauugcgccaacgcgucuaaugugcaggcugugaacagaagcgccgccaaaggagucacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccuggggaguauuacaacggaacacgggaggaccgcaauaaacugagacaucugauuagcgugaagcucggcaagauccccaccguugaaaacucuauuuuccacauggcugccugguccggcagcgcuugccaugaugggaaagaguggacauauaucggaguggacggcccugauucuaaugcccugcuuaagauuaaauacggggaagcguacaccgacacguaucacuccuacgccaagaacauccugcggacacaagagagcgcuuguaauugcauuggaggcgauuguuaucucaugaucaccgacgggcccgccuccggaaucucugagugccgcuuucugaaaauuagagaaggccggaucauuaaggagaucuucccgacaggccgcgucaagcacaccgaagaguguaccugcggguuugcuagcaacaaaacaauugaaugugccugcagagauaauuccuacacggccaagcggccuuucgugaaacuuaacguugagaccgacacagcugagauccgccugaugugcaccgaaacauaucucgauacccccagaccuaaugacggaagcaucacgggccccugugagucugauggggacaagggauccggcgggauuaaaggaggcuuugugcaucagcggauggcgagcaagaucggccgcugguacucuagaacaaugagcaaaaccaagcggauggggaugggacuguaugucaaguacgacggcgaucccuggaccgacuccgaagcccuggcucucucuggggugauggugagcauggaggaaccuggaugguacuccuucggcuuugagauuaaagauaagaaaugcgacgucccguguaucgggauugagaugguucacgauggcggaaagacaaccuggcauagcgccgccacagcuaucuauugccugaugggcucugggcagcuucugugggacacggugaccggaguggauauggcccucuga

SEQ ID NO: 212079 - RNA, 1401 nt, Artificial Sequence
  derived and/or modified sequence opt5 from neuraminidase__InfluenzaB__AFJ91042
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuuauccccgaaccugaguggaccuauccccggcuguccuguccuggcagcacauuccagaaggcucuccugauuucuccccaccgcuuuggggaaaccaaaggaaauuccgccccucuuaucaucagagagccguucauugcuugcggccccacggaauguaagcauuuugcccugacccacuacgcggcccagccugggggauauuacaacggcacacgggaggaccgcaauaaacucagacaucugaucagcgucaagcugggcaagauucccaccguggagaacucuaucuuccacauggcugccugguccgggagcgcuugccaugauggaaaagaauggacauauauuggcguugacgggccugauucuaaugcccuccugaagaucaaauacggagaggcguacaccgacacguaucacuccuacgccaagaacauucuucggacacaagaaagcgcuuguaauugcaucggcggggauuguuaucugaugaucaccgacggacccgccuccggcauuucugagugccgcuuucucaaaaucagagagggccggauuaucaaggaaauuuucccgacagggcgcgugaagcacaccgaggaauguaccugcggauuugcuagcaacaaaacaaucgagugugccugcagagauaauuccuacacggccaagcggccuuucgucaaacugaacguggaaaccgacacagcugagauccgccuuaugugcaccgagacauaucuggauacccccagaccuaaugacggcagcauugcggggcccugugaaucugauggagacaagggcuccgggggaaucaaaggcggcuuuguucaucagcggaugacgagcaagauugggcgcugguacucuagaacaaugagcaaaaccaagcggaugggaaugggccucuaugugaaguacgacggggaucccuggaccgacuccgaggcccuggcucugucuggagucauggugagcauggaggaaccuggcugguacuccuucggguuugaaaucaaagauaagaaaugcgacgugccguguauuggcaucgagaugguccacgauggaggcaagacaaccuggcauagcgccgccacagcuaucuauugccucauggggucuggacagcugcuuugggacacgguuaccggcguggauauggcccuguga

SEQ ID NO: 212080 - RNA, 1401 nt, Artificial Sequence
  derived and/or modified sequence opt5 from neuraminidase__InfluenzaB__AFJ91053
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaagaagugacacugcuucugcccgagccugaauggaccuauccccggcucuccuguccuggaagcacauuccagaaggcucugcuuaucucuccccaccgcuuuggcgagaccaaaggaaauuccgccccucugauuaucagagaaccguucaucgcuugcgggcccacggaguguaagcauuuugcccucacccacuacgcggcccagccuggcggguauuacaacggaacacgggaggaccgcaauaaacugagacaucugauuagcgucaagcucggcaagauccccaccguggaaaacucuauuuuccacauggcugccugguccggcagcgcuugccaugaugggaaagaguggacauauaucggaguugacggcccugauucuaaugcccugcuuaagauuaaauacggggaagcguacaccgacacguaucacuccuacgccaagaacauccugcggacacaagagagcgcuuguaauugcauuggaggcgauuguuaucucaugaucaccgacgggcccgccuccggaaucucugagugccgcuuucugaaaauuagagaaggccggaucauuaaggagaucuucccgacaggccgcgugaagcacaccgaagaguguaccugcggguuugcuagcaacaaaacaauugaaugugccugcagagauaauuccuacacggccaagcggccuuucgucaaacuuaacguggagaccgacacagcugagauccgccugaugugcaccgaaacauaucucgauacccccagaccuaaugacggaagcaucacgggccccugugagucugauggggacaagggauccggcgggauuaaaggaggcuuuguucaucagcggauggcgagcaagaucggccgcugguacucuagaacaaugagcaaaaccaagcggauggggaugggacuguaugugaaguacgacggcgaucccuggaccgacuccgaagcccuggcucucucuggggucauggugagcauggaggaaccuggaugguacuccuucggcuuugagauuaaagauaagaaaugcgacgugccguguaucgggauugagaugguccacgauggcggaaagacaaccuggcauagcgccgccacagcuaucuauugccugaugggcucugggcagcuucugugggacacgguuaccggaguggauauggcccucuga

SEQ ID NO: 212081 - RNA, 1401 nt, Artificial Sequence
  derived and/or modified sequence opt5 from neuraminidase__InfluenzaB__AFJ91075
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaauacccugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccuguaugugaaguacgacggggaucccuggacagacuccgaggcgcuggcccucucuggagucauggugagcauggaggaaccuggcugguacuccuucggguuugaaauuaaagauaagaaaugcgacgugccguguaucggcauugagaugguccacgauggaggcaagaccacauggcauagcgcugccacggccaucuauugccugauggggucuggacagcuucugugggacaccguuacaggcguggauauggcucucuga

SEQ ID NO: 212082 - RNA, 1401 nt, Artificial Sequence; identical to SEQ ID NO: 211841
  derived and/or modified sequence opt5 from neuraminidase__InfluenzaB__AFJ91086

SEQ ID NO: 212083 - RNA, 1401 nt, Artificial Sequence; identical to SEQ ID NO: 211841
  derived and/or modified sequence opt5 from neuraminidase__InfluenzaB__AFJ91097

SEQ ID NO: 212084 - RNA, 1401 nt, Artificial Sequence; identical to SEQ ID NO: 211841
  derived and/or modified sequence opt5 from neuraminidase__InfluenzaB__AFJ91108

SEQ ID NO: 212085 - RNA, 1401 nt, Artificial Sequence; identical to SEQ ID NO: 211841
  derived and/or modified sequence opt5 from neuraminidase__InfluenzaB__AFJ91119

SEQ ID NO: 212086 - RNA, 1401 nt, Artificial Sequence; identical to SEQ ID NO: 211692
  derived and/or modified sequence opt5 from neuraminidase__InfluenzaB__AFJ91707

SEQ ID NO: 212087 - RNA, 1401 nt, Artificial Sequence
  derived and/or modified sequence opt5 from neuraminidase__InfluenzaB__AFK09801
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaaggaauguaaacauuuugcucucacacacuacgccgcgcagccugggggauauuacaacggcacccgggaggaccgcaauaagcugagacaucugaucagcgucaagcucggcaaaauucccacaguggagaacucuaucuuccacauggccgcuugguccgggagcgccugccaugauggacgggaauggaccuauauuggcguugacgggccugauucuaaugcucugcuuaagaucaaauacggagaggccuacacggacacauaucacuccuacgcgaagaacauucugcgcacccaagaaagcgccuguaauugcaucggcggggauuguuaucucaugauuacagacggauccgcuucuggcaucagcgagugcagauuucugaaaauccgggagggccgcauuaucaaggaaauuuuccccaccgggagagugaagcacaccgaggaauguacaugcggauuugccuccaacaaaacgaucgagugugcuugccgggauaauagcuacaccgccaagcgcccguucgucaaacuuaacguggaaacagacaccgccgagauuagacugaugugcacagagaccuaucucgauacgccucggcccaaugacggcucuaucacagggccuugugaauccaacggagaucgcggcagcgggggaaucaagggcggcuuuguucaucagagaauggcuucuaaaauugggcggugguacagcagaaccauguccaagaccaaacgcaugggaaugggccuguaugugaaguacgacggggaccccuggacagauucugaggcgcuggcccucagcggagucauggugcccauggaggaaccuggcugguacuccuucggguuugaaaucaaggacaaaaagugcgaugugccguguauuggcaucgagaugguccacgacggaggcaaaaccacauggcauagcgcugccacggccauuuauugccugauggggucuggacagcuucugugggauaccguuacaggcguggacauggcucucuga

SEQ ID NO: 212088 - RNA, 1401 nt, Artificial Sequence; identical to SEQ ID NO: 211816
  derived and/or modified sequence opt5 from neuraminidase__InfluenzaB__AFN54669

SEQ ID NO: 212089 - RNA, 1401 nt, Artificial Sequence; identical to SEQ ID NO: 211816
  derived and/or modified sequence opt5 from neuraminidase__InfluenzaB__AFN54680

SEQ ID NO: 212090 - RNA, 1401 nt, Artificial Sequence; identical to SEQ ID NO: 211841
  derived and/or modified sequence opt5 from neuraminidase__InfluenzaB__AFN54691

SEQ ID NO: 212091 - RNA, 1401 nt, Artificial Sequence; identical to SEQ ID NO: 211841
  derived and/or modified sequence opt5 from neuraminidase__InfluenzaB__AFN54702

SEQ ID NO: 212092 - RNA, 1401 nt, Artificial Sequence; identical to SEQ ID NO: 211841
  derived and/or modified sequence opt5 from neuraminidase__InfluenzaB__AFN54713

SEQ ID NO: 212093 - RNA, 1401 nt, Artificial Sequence; identical to SEQ ID NO: 211841
  derived and/or modified sequence opt5 from neuraminidase__InfluenzaB__AFN54724

SEQ ID NO: 212094 - RNA, 1401 nt, Artificial Sequence; identical to SEQ ID NO: 211841
  derived and/or modified sequence opt5 from neuraminidase__InfluenzaB__AFN54735

SEQ ID NO: 212095 - RNA, 1401 nt, Artificial Sequence; identical to SEQ ID NO: 211841
  derived and/or modified sequence opt5 from neuraminidase__InfluenzaB__AFN54746

SEQ ID NO: 212096 - RNA, 1401 nt, Artificial Sequence; identical to SEQ ID NO: 211841
  derived and/or modified sequence opt5 from neuraminidase__InfluenzaB__AFN54757

SEQ ID NO: 212097 - RNA, 1401 nt, Artificial Sequence; identical to SEQ ID NO: 211841
  derived and/or modified sequence opt5 from neuraminidase__InfluenzaB__AFN54768

SEQ ID NO: 212098 - RNA, 1401 nt, Artificial Sequence; identical to SEQ ID NO: 211841
  derived and/or modified sequence opt5 from neuraminidase__InfluenzaB__AFN54779

SEQ ID NO: 212099 - RNA, 1401 nt, Artificial Sequence; identical to SEQ ID NO: 211841
  derived and/or modified sequence opt5 from neuraminidase__InfluenzaB__AFN54790

SEQ ID NO: 212100 - RNA, 1401 nt, Artificial Sequence; identical to SEQ ID NO: 211841
  derived and/or modified sequence opt5 from neuraminidase__InfluenzaB__AFN54801

SEQ ID NO: 212101 - RNA, 1401 nt, Artificial Sequence; identical to SEQ ID NO: 211841
  derived and/or modified sequence opt5 from neuraminidase__InfluenzaB__AFN54812

SEQ ID NO: 212102 - RNA, 1401 nt, Artificial Sequence
  derived and/or modified sequence opt5 from neuraminidase__InfluenzaB__AFN54834
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggaucuauauuggcguugacgggccugauucuaaugcucugcuuaagaucaaauacggagaggccuacacagacaccuaucacuccuacgcgaagaacauucugagaacgcaggaaagcgccuguaauugcaucggcggggauuguuaucucaugaucacagacggacccgcuuccggcauuucugagugccgguuucugaaaauccgcgagggcagaauuaucaaggaaauuuucccgaccgggcgggugaagcacacagaggaauguaccugcggauuugccagcaacaaaaccaucgagugugcuugccgcgauaauuccuacacagccaagagaccuuucgucaaacuuaacguggaaacggacaccgccgagauccggcugaugugcacagagaccuaucucgauacaccccgcccuaaugacggcagcauuaccgggcccugugaaucuaacggagauaagggcuccgggggaaucaaaggcggcuuuguucaucaaagaauggcuagcaagauugggcggugguacucuagaacgaugagcaaaacaaagcgcaugggaaugggccuguaugugaaguacgacggggaccccuggaccgauuccgaggcgcuggcccucucuggagucauggugagcauggaggaaccuggcugguacuccuucggguuugaaaucaaagacaagaaaugcgaugugccguguauuggcaucgagaugguccacgacggaggcaagaccacauggcauagcgcugccaccgccaucuauugccugauggggucuggacagcuucugugggauacaguuacgggcgugaauaugacccucuga

SEQ ID NO: 212103 - RNA, 1401 nt, Artificial Sequence; identical to SEQ ID NO: 211841
  derived and/or modified sequence opt5 from neuraminidase__InfluenzaB__AFN54845

SEQ ID NO: 212104 - RNA, 1401 nt, Artificial Sequence
  derived and/or modified sequence opt5 from neuraminidase__InfluenzaB__AFN54856
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcgugucugagugccgguuucugaaaauccgcgagggcagaauuaucaaggaaauuuucccgacagggcgggucaagcacaccgaggaauguaccugcggauuugccagcaacaaaacaaucgagugugcuugccgcgauaauuccuacacggccaagagaccuuucgugaaacuuaacguugaaaccgacacagccgagauucggcugaugugcaccgagacauaucucgauacgccccgcccuaaugacggcagcaucaccgggcccugugaaucuaacggagauaagggcuccgggggaaucaaaggcggcuuugugcaucaaagaauggcuagcaagauugggcggugguacucuagaacaaugagcaaaaccaagcgcaugggaaugggccuguaugucaaguacgacggggaccccuggaccgauuccgaggcgcuggcccucucuggagugauggugagcauggaggaaccuggcugguacuccuucggguuugaaaucaaagacaagaaaugcgaugucccguguauuggcaucgagaugguucacgacggaggcaagacaaccuggcauagcgcugccacagccauuuauugccugauggggucuggacagcuucugugggauacggcuaccggcgugaauaugacacucuga

SEQ ID NO: 212105 - RNA, 1401 nt, Artificial Sequence; identical to SEQ ID NO: 211841
  derived and/or modified sequence opt5 from neuraminidase__InfluenzaB__AFN54867

SEQ ID NO: 212106 - RNA, 1401 nt, Artificial Sequence
  derived and/or modified sequence opt5 from neuraminidase__InfluenzaB__AFU34598
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggagugacauuccugcuucccgaaccugaguggaccuauccccggcugagcuguccuggcucuacguuucagaaggcccuccugauuagcccccaccgcuucggggaaaccaaaggaaauuccgcuccucuuaucauuagagagccguuuaucgccugcggccccaacgaauguaagcauuucgcucugacacacuacgccgcgcagccugggggauauuacaauggcacccggggcgaccgcaacaaacucagacaucugaucucugucaagcuggggaagauucccacaguggaaaauuccaucuuucacauggccgcuuggagcggaucugccugccaugauggcaaagaguggaccuauauugggguugacggaccugauaacaaugcucuccugaaggugaaauacggcgaggccuacacggacacauaucacuccuacgcgaacaagauccuucggacccgcgagagcgccuguaauugcauugggggaaacuguuaucugaugaucacagauggcuccgcuucuggcgucagcgaaugcagauuccucaaaauucggguggggcgcaucaucaaggagauuuuucccaccggaagaguuaagcacaccgaggaauguacaugcggcuucgccuccaauaaaacgaucgagugugcuugccgggacaacagcuacaccgccaagcgcccguuugugaaacugaaugucgaaacagauaccgccgagauuagacuuaugugcacagacaccuaucuggauacgccucggcccgacgaugggucuaucacaggaccuugugaauccaacggcgacaaggggagcggaggcauuaaaggcggguucgugcaucagcgcauggagucuaagaucggaagaugguacagccggaccauguccaaaaccgagagaaugggcauggggcucuaugugaaguacgacggagaucccugggcugacucugaugcgcuggccuuuagcggcgucaugguuuccaugaaggaacccgggugguacagcuucggcuucgagaucaaagacaagaaaugcgaugugccuuguauuggaaucgaaauggugcacgacggcgggaaggagacauggcauucugcugccaccgccauuuauugccugaugggauccggccaacuccugugggauacagucacggggguggacguugcucuuuga

SEQ ID NO: 212107 - RNA, 1401 nt, Artificial Sequence
  derived and/or modified sequence opt5 from neuraminidase__InfluenzaB__AFU34609
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccacccggggagugacauuccuucugcccgaaccugagugggccuauccccgccucuccuguccuggcagcaccuuucagaaagcucugcuuauuucuccccacagauucggggaaacgaagggaaauuccgccccucugaucauucgggagccguuuaucgcuugcggccccaacgaauguaaacauuucgcccucacccacuacgcggcccagccugggggauauuacaauggcacacgcggcgacagaaacaagcugcggcaucugaucagcgucaaacucgggaagauucccaccguggaaaauucuaucuuucacauggcugccugguccggaagcgcuugccaugauggcaaggaguggacauauauugggguugacggaccugauaacgacgcccugcuuaaagugaaguacggcgaggcguacaccgauacguaucacucuuacgccaauaaaauccugcgcacacaggaguccgcuuguaacugcauugggggaaauuguuaucucaugaucaccgacggcagcgccuccggcgucucugaaugcagauuccugaagauucgggaggggcgcaucaucaaagagauuuuucccacaggaagagugaagcacaccgaagaguguaccugcggcuucgcuagcaacaagacaaucgaaugugccugccgggauaauuccuacacggccaaacgcccguuuguuaaacuuaacguggagaccgacacagcugaaauuagacugaugugcaccgauacauaucucgacaccccucggcccgaugacgggagcaucacgggaccuugugagucuaauggcgacaagggguccggaggcauuaagggcggguucguccaucaacgcauggagagcaaaaucggaagaugguacucucggacaaugagcaagaccgaaagaaugggcauggggcuguaugugaaauacgauggagaccccugggcggauuccgacgcccuggcuuuuucuggcgugauggucagcaugaaggagcccgggugguacuccuucggcuucgaaaucaaggauaaaaagugcgacguuccuuguauuggaaucgagauggugcacgauggcgggaaagaaaccuggcauagcgccgccacagcuauuuauugccucaugggaucuggccagcugcuuugggacaccgugacaggggucgauauggcccuguga

SEQ ID NO: 212108 - RNA, 1401 nt, Artificial Sequence
  derived and/or modified sequence opt5 from neuraminidase__InfluenzaB__AFU34620
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccacccggggagugacauuccuucugcccgaaccugaguggaccuauccccgccucuccuguccuggcagcacguuucagaaagcccugcuuauuucuccccacagauucggggaaaccaagggaaauuccgcuccucugaucauucgggagccguuuaucgccugcggccccaacgaauguaaacauuucgcucucacacacuacgccgcgcagccugggggauauuacaauggcacccgcggcgacagaaacaagcugcggcaucugaucagcgucaaacucgggaagauucccacaguggaaaauucuaucuuucacauggccgcuugguccggaagcgccugccaugauggcaaggaguggaccuauauugggguugacggaccugauaacgacgcucugcuuaaagugaaguacggcgaggccuacacggauacauaucacucuuacgcgaauaaaauccugcgcacccaggaguccgccuguaacugcauugggggaaauuguuaucucaugaucacagacggcagcgcuuccggcgucucugaaugcagauuccugaagauucgggaggggcgcaucaucaaagagauuuuucccaccggaagagugaagcacaccgaagaguguacaugcggcuucgccagcaacaagacgaucgaaugugcuugccgggauaauuccuacaccgccaaacgcccguuuguuaaacuuaacguggagacagacaccgccgaaauuagacugaugugcacagauaccuaucucgacacgccucggcccgaugacgggagcaucacaggaccuugugagucuaauggcgacaagggguccggaggcauuaagggcggguucguccaucaacgcauggagagcaaaaucggaagaugguacucucggaccaugagcaagaccgaaagaaugggcauggggcuguaugugaaauacgauggagaccccugggcugauuccgacgcgcuggccuuuucuggcgugauggucagcaugaaggagcccgggugguacuccuucggcuucgaaaucaaggauaaaaagugcgacguuccuuguauuggaaucgagauggugcacgauggcgggaaagaaacauggcauagcgcugccaccgccauuuauugccucaugggaucuggccagcugcuuugggacacagugacgggggucgauauggcucuguga

SEQ ID NO: 212109 - RNA, 1401 nt, Artificial Sequence
  derived and/or modified sequence opt5 from neuraminidase__InfluenzaB__AFU34631
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccacccggggagugacauuccuucugcccgaaccugaguggaccuauccccgccucuccuguccuggcagcacguuucagaaagcccugcuuauuucuccccacagauucggggaaaccaagggaaauuccgcuccucugaucauucgggagccguuuaucgccugcggccccaacgaauguaaacauuucgcucucacacacuacgccgcgcagccugggggauauuacaauggcacccgcggcgacagaaacaagcugcggcaucugaucagcgucaaacucgggaagauucccacaguggaaaauucuaucuuucacauggccgcuugguccggaagcgccugccaugauggcaaggaguggaccuauauugggguugacggaccugauaacgacgcucugcuuaaagugaaguacggcgaggccuacacggauacauaucacucuuacgcgaauaaaauccugcgcacccaggaguccgccuguaacugcauuagagggaauuguuaucucaugaucacagacggaagcgcuuccggcgucucugaaugccgguuccugaagauucgcgagggcagaaucaucaaagagauuuuucccaccgggcgggugaagcacaccgaagaguguacaugcggauucgccagcaacaagacgaucgaaugugcuugccgcgauaauuccuacaccgccaaaagaccguuuguuaaacuuaacguggagacagacaccgccgaaauucggcugaugugcacagauaccuaucucgacacgccucgccccgaugacggcagcaucacagggccuugugagucuaauggagacaagggcuccgggggaauuaagggcggcuucguccaucaaagaauggagagcaaaaucgggcggugguacucuagaaccaugagcaagaccgaacgcaugggaaugggccuguaugugaaauacgauggggaccccugggcugauuccgacgcgcuggccuuuucuggagugauggucagcaugaaggagcccggcugguacuccuucggguucgaaaucaaggauaaaaagugcgacguuccuuguauuggcaucgagauggugcacgauggaggcaaagaaacauggcauagcgcugccaccgccauuuauugccucauggggucuggacagcugcuuugggacacagugacgggcgucgauauggcucuguga

SEQ ID NO: 212110 - RNA, 1401 nt, Artificial Sequence
  derived and/or modified sequence opt5 from neuraminidase__InfluenzaB__AFU34642
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggaaugacauuccugcuucccgaaccugaguggaccuauccccggcugagcuguccuggcucuacguuucagaaggcccuccugauuagcccccaccgcuucggggaaaccaaaggaaauuccgcuccucuuaucauuagagagccguuuaucgccugcggccccaacggguguaagcauuucgcucugacacacuacgccgcgcagccuggaggcuauuacaauggcacccgcggggaccggaacaaacucagacaucugaucucugugaagcugggaaagauucccacagucgaaaauuccaucuuucacauggccgcuuggagcggcucugccugccaugaugggaaagaguggaccuauauuggaguggacggcccugauaacaaugcucuccugaagguuaaauacggggaggccuacacggacacauaucacuccuacgcgaacaagauccuucggacccaggaaagcgccuguaauugcauuggaggcaacuguuaucugaugaucacagauggcuccgcuucuggggugagcgagugccgcuuccucaaaauuagagaaggacggaucaucaaggagauuuuucccaccggccgcgucaagcacaccgaggaauguacaugcggguucgccuccaauaaaacgaucgagugugcuugcagagacaacagcuacaccgccaagcggccguuugugaaacugaauguugaaacagauaccgccgagauucgccuuaugugcacagacaccuaucuggauacgccuagacccgacgauggaucuaucacaggcccuugugaauccuacggggacaagggaagcggcggcauuaaagggggauucgugcaucaacggauggagucuaagaucggccgcugguauagcagaaccauguccaaaaccgagcggauggggaugggacucuacgucaaguacgacggcgaucccugggcugacucugaugcgcuggccuuuagcggggugaugguguccaugaaggaacccggcugguauagcuucggauucgagaucaaagacaagaaaugcgaugucccuuguauuggcaucgaaaugguucacgacgggggaaaggagacauggcauucugcugccaccgccauuuacugccugaugggcuccgggcagcuccugugggauacagugacgggaguggacauggcucuuuga

SEQ ID NO: 212111 - RNA, 1401 nt, Artificial Sequence
  derived and/or modified sequence opt5 from neuraminidase__InfluenzaB__AGB97261
augcugcccagcaccauccagacacucacgcuguuccuuaccuccggcggggugcugcucucucuguacgucagcgccucccuuucuuaucugcucuacagcgacaugcugcugaaguuuuccagaacagagauuaccgcuccuaucaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuauuucuccccacagauuuggggaaacgaaaggaaauuccgcuccucugaucauucgggagccguucaucgccugcggccccaaggaauguaaacauuuugcucucacccacuacgccgcgcagccugggggauauuacaacggcacacgcgaggacagaaauaagcugcggcaucugaucagcgucaagcucggcaaaauucccaccguggagaacucuaucuuccacauggccgcuugguccgggagcgccugccaugauggacgcgaauggacauauauuggcguugacgggccugauucuaaugcucugcuuaagaucaaauacggagaggccuacaccgacacguaucacuccuacgcgaagaacauucugagaacacaggaaagcgccuguaauugcaucggcggggauuguuaucucaugauuaccgacggacccgcuuccggcaucucugagugccgguuucugaaaauccgcgagggcagaauuaucaaggaaauuuucccgacagggcgggugaagcacaccgaggaauguaccugcggauuugccagcaacaaaacaaucgagugugcuugccgcgauaauuccuacacggccaagagaccuuucgucaaacuuaacguggaaaccgacacagccgagauucggcugaugugcaccgagacauaucucgauacgccccgcccuaaugacggcagcaucaccgggcccugugaaucuaacggagauaagggcuccgggggaaucaaaggcggcuuuguucaucaaagaauggcuagcaagauugggcggugguacucuagaacaaugagcaaaaccaagcgcaugggaaugggccuguaugugaaguacgacggggaccccuggaccgauuccgaggcgcuggcccucucuggagucauggugagcauggaggaaccuggcugguacuccuucggguuugaaaucaaagacaagaaaugcgaugugccguguauuggcaucgagaugguccacgacggaggcaagacaaccuggcauagcgcugccacagccauuuauugccugauggggucuggacagcuucugugggauacgguuaccggcgugaauaugacacucuga

SEQ ID NO: 212112 - RNA, 1401 nt, Artificial Sequence
  derived and/or modified sequence opt5 from neuraminidase__InfluenzaB__AGB97267
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaauuaaaggaaauuccgcuccucugaucaucagagagccguucauugccugcggccccacggaauguaagcauuuugcucucacccacuacgccgcgcagccugggggauauuacaacggcacacgggaggaccgcaauaaacugagacaucugaucagcgucaagcucggcaagauucccaccguggagaacucuaucuuccacauggccgcuugguccgggagcgccugccaugauggaaaagaauggacauauauuggcaucgacgggccugauucuaaugcucugcuuaagauuaaauacggagaggccuacaccgacacguaucacuccuacgcgaagaacauccugcggacacaagaaagcgccuguaauugcaucggcggggauuguuaucucaugauuaccgacggacccgcuuccggcguuucugagugccgcuuucugaaaaucagagagggccggauuaucaaggaaauuuucccgacagggcgcgugaagcacaccgaggaauguaccugcggauuugccagcaacaaaacaaucgagugugcuugcagagauaaucgguacacggccaagcgcccuuucgucaaacuuaacguggaaaccgacacagccgagaucagacugaugugcaccgagacauaucucgauacgccccggccuaaugacggcuccauuaccgggcccugugaaagcgauggagacaagggcucugggggaaucaaaggcggcuuuguucaucagcgcauggcuuccaagauugggagaugguacagccggacaaugucuaaaaccaagagaaugggaaugggccuguaugugaaguacgacggggaucccuggaccgacagcgaggcgcuggcccucuccggagucauggugucuauggaggaaccuggcugguacagcuucggguuugaaaucaaagauaagaaaugcgacgugccguguauuggcaucgagaugguccacgauggaggcaagacaaccuggcauuccgcugccacagccaucuauugccugauggggagcggacagcuucugugggacacgguuaccggcguggauauggcucucuga

SEQ ID NO: 212113 - RNA, 1401 nt, Artificial Sequence; identical to SEQ ID NO: 211841
  derived and/or modified sequence opt5 from neuraminidase__InfluenzaB__AGR54784

SEQ ID NO: 212114 - RNA, 1401 nt, Artificial Sequence; identical to SEQ ID NO: 211706
  derived and/or modified sequence opt5 from neuraminidase__InfluenzaB__AGX15491

SEQ ID NO: 212115 - RNA, 1401 nt, Artificial Sequence
  derived and/or modified sequence opt5 from neuraminidase__InfluenzaB__AGX15533
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcaaacggggcgaccgcaacaagcugagacaucugaucagcgucaagcucgggaaaauuccuaccguggaaaauucuaucuuccacauggccgcuugguccggaagcgccugccaugauggcaaggaguggacauauauugggguugacggacccgauaacaaugcucugcuuaaaaucaaguacggcgaggccuacaccgacacguaucacucuuacgcgaacaauauucugcggacacaggaguccgccuguaacugcaucgggggaaauuguuaucucaugauuaccgauggcagcgcuuccggcgugucugaaugccgcuuucugaaaaucagagaggggcggaucauuaaggagaucuucccgacaggacgcgucaagcacaccgaagaguguaccugcggcuuugccagcaacaaaacaauugaaugugcuugcagagacaauuccuacacggccaagcggccuuucgugaaacuuaacguugagaccgauacagccgaaauccgccugaugugcaccgacacauaucucgauacccccagaccugacgaugggagcauuacgggacccugugagucuaacggcgacaagggguccggaggcaucaaaggcggguuugugcaucaacggauggcuagcaaggucggacgcugguacucuagaacaaugagcaaaaccgagcggaugggcauggggcuguaugugaaguacgacggagaucccugggcggacuccgaugcccuggcuuucucuggcgugauggucagcaugaaggaaccugggugguacuccuuuggcuucgagaucaaagacaagaaaugcgauguuccguguauuggaaucgaaauggugcacgacggcgggaaggagaccuggcauagcgccgccacagcuauuuauugccucaugggaucuggccagcugcuuugggauaccgugacaggggucgacauggcccuguga

SEQ ID NO: 212116 - RNA, 1401 nt, Artificial Sequence; identical to SEQ ID NO: 211659
  derived and/or modified sequence opt5 from neuraminidase__InfluenzaB__AGX15545

SEQ ID NO: 212117 - RNA, 1401 nt, Artificial Sequence; identical to SEQ ID NO: 211659
  derived and/or modified sequence opt5 from neuraminidase__InfluenzaB__AGX15556

SEQ ID NO: 212118 - RNA, 1401 nt, Artificial Sequence
  derived and/or modified sequence opt5 from neuraminidase__InfluenzaB__AGX15567
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccgaacggaugggcauggggcuguaugugaaguacgacggagaccccugggcggauuccgacgcccuggcuuucucuggcgucauggugagcauggaggaaccugggugguacuccuuuggcuucgagaucaaggauaaaaagugcgacgugccguguauuggaaucgaaaugguccacgauggcgggaaagagacauggcauagcgccgccaccgcuauuuauugccucaugggaucuggccagcugcuuugggacacaguuacgggggugaacauggcccuguga

SEQ ID NO: 212119 - RNA, 1401 nt, Artificial Sequence; identical to SEQ ID NO: 211659
  derived and/or modified sequence opt5 from neuraminidase__InfluenzaB__AGX15578

SEQ ID NO: 212120 - RNA, 1401 nt, Artificial Sequence; identical to SEQ ID NO: 211659
  derived and/or modified sequence opt5 from neuraminidase__InfluenzaB__AGX15589

SEQ ID NO: 212121 - RNA, 1401 nt, Artificial Sequence; identical to SEQ ID NO: 211865
  derived and/or modified sequence opt5 from neuraminidase__InfluenzaB__AGX15600

SEQ ID NO: 212122 - RNA, 1401 nt, Artificial Sequence; identical to SEQ ID NO: 211865
  derived and/or modified sequence opt5 from neuraminidase__InfluenzaB__AGX15611

SEQ ID NO: 212123 - RNA, 1401 nt, Artificial Sequence; identical to SEQ ID NO: 211985
  derived and/or modified sequence opt5 from neuraminidase__InfluenzaB__AGX15644

SEQ ID NO: 212124 - RNA, 1401 nt, Artificial Sequence; identical to SEQ ID NO: 211985
  derived and/or modified sequence opt5 from neuraminidase__InfluenzaB__AGX15655

SEQ ID NO: 212125 - RNA, 1401 nt, Artificial Sequence; identical to SEQ ID NO: 211985
  derived and/or modified sequence opt5 from neuraminidase__InfluenzaB__AGX15666

SEQ ID NO: 212126 - RNA, 1401 nt, Artificial Sequence; identical to SEQ ID NO: 211985
  derived and/or modified sequence opt5 from neuraminidase__InfluenzaB__AGX15679

SEQ ID NO: 212127 - RNA, 1401 nt, Artificial Sequence
  derived and/or modified sequence opt5 from neuraminidase__InfluenzaB__AGX15690
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggagaauagcaucuuccacauggccgcuugguccggaagcgccugccaugauggcaaagaguggaccuauauugggguugacggacccgauaacaaugcucugcuuaaggugaaauacggcgaagccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggaugaagucuaaaaucggacgcugguacucuagaaccaugagcaagaccgagcggaugggcauggggcuguaugugaaguacgacggagaccccugggcugauuccgacgcgcuggccuucucuggcgugauggucagcaugaaagaaccugggugguacuccuuuggcuucgagaucaaggauaaaaagugcgacguuccguguauuggaaucgaaauggugcacgauggcgggaaagagacauggcauagcgcugccaccgccauuuauugccucaugggaucuggccagcugcuuugggacacagugacgggggucgauauggcucuguga

SEQ ID NO: 212128 - RNA, 1401 nt, Artificial Sequence; identical to SEQ ID NO: 211985
  derived and/or modified sequence opt5 from neuraminidase__InfluenzaB__AGX15701

SEQ ID NO: 212129 - RNA, 1401 nt, Artificial Sequence
  derived and/or modified sequence opt5 from neuraminidase__InfluenzaB__AGX15712
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaccgaaaggaaauuccgcuccccugaucauuagagagccuuucaucgccugcggccccaacgaauguaagcauuuugcucucacccacuacgccgcgcagccugggggauauuacaauggcacacggggcgaccgcaacaaacugagacaucugaucagcgucaagcucgggaagauucccaccguggaaaauucuaucuuccacauggccgcuugguccggaagcgccugccaugauggcaaagaguggacauauauugggguugacggaccggauaacaaugcucugcuuaaggugaaauacggcgaggccuacaccgacacguaucacucuuacgcgaacaagauccugcggacacaggaguccgccuguaauugcauugggggaaacuguuaucucaugaucaccgauggcagcgcuuccggcgucucugaaugccgcuuucugaaaauuagagaggggcggaucaucaaggagauuuucccuacaggacgcgugaagcacaccgaagaguguaccugcggcuuugccagcaauaaaacaaucgaaugugcuugcagagacaacuccuacacggccaagcggcccuucguuaaacuuaauguggagaccgauacagccgaaauucgccugaugugcaccgacacauaucucgauaccccuagacccaacgacgggagcaucacgggacccugugagucugauggcgacaagggguccggaggcauuaaaggcggguuuguccaucaacggauggagagcaagaucggacgcugguacucuagaacaaugagcaaaaccgaacggaugggcauggggcuguaugugaaguacgacggagauccuugggcugacuccgaugcgcuggccuucucuggcgugauggucagcaugaaggagccggggugguacuccuuuggcuucgaaaucaaagacaagaaaugcgauguucccuguauuggaaucgagauggugcacgacggcgggaaggaaaccuggcauagcgcugccacagccauuuauugccucaugggaucuggccagcugcuuugggauaccgugacaggggucaacauggcucuguga

SEQ ID NO: 212130 - RNA, 1401 nt, Artificial Sequence; identical to SEQ ID NO: 211985
  derived and/or modified sequence opt5 from neuraminidase__InfluenzaB__AGX15723

SEQ ID NO: 212131 - RNA, 1401 nt, Artificial Sequence; identical to SEQ ID NO: 211985
  derived and/or modified sequence opt5 from neuraminidase__InfluenzaB__AGX15745

SEQ ID NO: 212132 - RNA, 1401 nt, Artificial Sequence; identical to SEQ ID NO: 211985
  derived and/or modified sequence opt5 from neuraminidase__InfluenzaB__AGX15757

SEQ ID NO: 212133 - RNA, 1401 nt, Artificial Sequence
  derived and/or modified sequence opt5 from neuraminidase__InfluenzaB__AGX15768
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcuggccuucucuggcgugaugaucagcaugaaggagccugggugguacuccuuuggcuucgaaauuaaagauaagaaaugcgacgucccguguaucggaauugagaugguucacgauggcgggaaggaaacauggcauagcgcugccaccgccaucuauugccucaugggaucuggccagcugcuuugggacacagugacggggguggauauggcucuguga

SEQ ID NO: 212134 - RNA, 1401 nt, Artificial Sequence
  derived and/or modified sequence opt5 from neuraminidase__InfluenzaB__AGX15801
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcguuaacgccagcaaugugcaagcggugaacagauccgcuaccaaaggagucacacugcuucugcccgaaccugaguggaccuauccccggcucagcuguccuggcucuacguuccagaaggcccugcuuauuagcccccaccgcuuuggggaaaccaaaggaaauuccgccccucugaucauuagagagccguucaucgcuugcggccccaacgaauguaagcauuuugcccucacacacuacgcugcccagccugggggauauuacaauggcacccggggcgaccgcaacaaacugagacaucugaucucugugaagcucgggaagauucccacaguugaaaauuccaucuuccacauggcggccuggagcggaucugcuugccaugauggcaaagaguggaccuauauugggguggacggaccugauaacaaugcccugcuuaaggucaaauacggcgaggcuuacacggacacauaucacuccuacgccaacaagauccugcggacccaggagagcgcguguaauugcauugggggaaacuguuaucucaugaucacagauggcuccgccucuggcgugagcgaaugccgcuuucugaaaauuagagaggggcggaucaucaaggagauuuuccccaccggacgcguuaagcacaccgaagaguguacaugcggcuuugcuuccaauaaaacgaucgaaugugccugcagagacaacagcuacaccgcuaagcggccguucgugaaacuuaaugucgagacagauaccgccgaaauucgccugaugugcacagacaccuaucucgauacgccuagacccaacgacgggucuaucacaggaccuugugaguccaacggcgauaaggggagcggaggcauuaaaggcggguuugugcaucaacggauggagucuaagaucggacgcugguacagcagaaccauguccaaaaccgaacggaugggcauggggcuguaugugaaguacgacggagaccccugggccgauucugacgcucuggcguucagcggcgucaugguuuccaugaaggagcccgggugguacagcuuuggcuucgaaaucaaagauaagaaaugcgacgugccuuguauuggaaucgagauggugcacgauggcgggaaggaaacauggcauucugccgcuaccgccauuuauugccucaugggauccggccagcugcuuugggacacagucacggggguggauauggcccuguga

SEQ ID NO: 212135 - RNA, 1401 nt, Artificial Sequence; identical to SEQ ID NO: 211985
  derived and/or modified sequence opt5 from neuraminidase__InfluenzaB__AGX15812

SEQ ID NO: 212136 - RNA, 1401 nt, Artificial Sequence; identical to SEQ ID NO: 211985
  derived and/or modified sequence opt5 from neuraminidase__InfluenzaB__AGX15823

SEQ ID NO: 212137 - RNA, 1401 nt, Artificial Sequence; identical to SEQ ID NO: 211919
  derived and/or modified sequence opt5 from neuraminidase__InfluenzaB__AGX15845

SEQ ID NO: 212138 - RNA, 1401 nt, Artificial Sequence; identical to SEQ ID NO: 211896
  derived and/or modified sequence opt5 from neuraminidase__InfluenzaB__AGX15856

SEQ ID NO: 212139 - RNA, 1401 nt, Artificial Sequence; identical to SEQ ID NO: 211919
  derived and/or modified sequence opt5 from neuraminidase__InfluenzaB__AGX15867

SEQ ID NO: 212140 - RNA, 1401 nt, Artificial Sequence; identical to SEQ ID NO: 211919
  derived and/or modified sequence opt5 from neuraminidase__InfluenzaB__AGX15889

SEQ ID NO: 212141 - RNA, 1401 nt, Artificial Sequence
  derived and/or modified sequence opt5 from neuraminidase__InfluenzaB__AGX15900
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacaccucuaauguucaagcggugaacagaagcgcuacaaaaggagugaccuuccuucugcccgaaccugaguggacguauccccggcucuccuguccuggcagcaccuuucagaaggcccugcuuauuucuccccaccgcuucggggaaacaaaaggaaauuccgccccucugaucauuagagagccguuuaucgcuugcggccccaacgaauguaagcauuucgcccucacccacuacgcugcccagccugggggauauuacaauggcacacggggcgaccgcaacaaacugagacaucugaucagcgucaagcucgggaagauucccaccguggaaaauucuaucuuucacauggcggccugguccggaagcgcuugccaugauggcaaagaguggacguauauugggguugacggaccugauaacgacgcccugcuuaaggugaaauacggcgaggcuuacacagauaccuaucacucuuacgccaauaagauccugcggacacaggaguccgcguguaacugcauugggggaaauuguuaucucaugaucaccgacggcagcgccuccggcgucucugaaugccgcuuccugaaaauuagagaggggcggaucaucaaggagauuuuucccaccggacgcgugaagcacacagaagaguguacgugcggcuucgcuagcaacaaaaccaucgaaugugccugcagagauaauuccuacacagcuaagcggccguuuguuaaacuuaacguggagaccgacacagccgaaauucgccugaugugcaccgauacguaucucgacacaccuagacccgaugacgggagcaucaccggaccuugugagucuaauggcgacaagggguccggaggcauuaaaggcggguucguccaucaacggauggagagcaagaucggacgcugguacucuagaaccaugagcaaaacagaacggagaggcauggggcuguaugugaaguacgauggagaccccugggccgauuccgacgcucuggcguuuucuggcgugauggucagcaugaaggagcccgggugguacuccuucggcuucgaaaucaaagauaagaaaugcgacguuccuuguauuggaaucgagauggugcacgauggcgggaaggaaaccuggcauagcgccgcuacagccauuuauugccucaugggaucuggccagcugcuuugggacacggugaccggggucgauauggcccuguga

SEQ ID NO: 212142 - RNA, 1401 nt, Artificial Sequence; identical to SEQ ID NO: 211919
  derived and/or modified sequence opt5 from neuraminidase__InfluenzaB__AGX15911

SEQ ID NO: 212143 - RNA, 1401 nt, Artificial Sequence
  derived and/or modified sequence opt5 from neuraminidase__InfluenzaB__AGX15933
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcgugaagcacaccgaagaguguaccugcggcuuugcuagcaauaaaacaaucgaaugugccugcagagacaacuccuacacggccaagcggccuuucguuaaacuuaauguggagaccgauacagcugaaauucgccugaugugcaccgacacauaucucgauacccccagaccuaacgacgggagcaucacgggacccugugagucugauggcgacaagggguccggaggcauuaaaggcggguuuguccaucaacggauggagagcaagaucggacgcugguacucuagaacaaugagcaaaaccgaacggaugggcauggggcuguaugugaaguacgacggagaucccugggcggacuccgaugcccuggcuuucucuggcgugauggucagcaugaaggagccugggugguacuccuuuggcuucgaaaucaaagacaagaaaugcgauguuccguguauuggaaucgagauggugcacgacggcgggaaggaaaccuggcauagcgccgccacagcuauuuauugccucaugggaucuggccagcugcuuugggauaccgugacaggggucgacauggcccuguga

SEQ ID NO: 212144 - RNA, 1401 nt, Artificial Sequence; identical to SEQ ID NO: 211919
  derived and/or modified sequence opt5 from neuraminidase__InfluenzaB__AGX15944

SEQ ID NO: 212145 - RNA, 1401 nt, Artificial Sequence; identical to SEQ ID NO: 211980
  derived and/or modified sequence opt5 from neuraminidase__InfluenzaB__AGX15966

SEQ ID NO: 212146 - RNA, 1401 nt, Artificial Sequence
  derived and/or modified sequence opt5 from neuraminidase__InfluenzaB__AGX15988
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaguccgccugaugugcacagacaccuaucucgauacgcccagaccuaacgacgggagcauuacaggacccugugagucugauggcgacaagggguccggaggcaucaaaggcggguuugugcaucaacggauggagagcaagauuggacgcugguacucuagaaccaugagcaaaaccgaacggaugggcauggggcuguaugugaaguacgacggagaucccugggcugacuccgaugcgcugacauucucuggcgucaugguuagcaugaaggagccugggugguacuccuuuggcuucgaaaucaaagacaagaaaugcgaugugccguguaucggaauugagauggugcacgacggcgggaaggaaaccuggcauagcgccgcuacagccaucuauugccucaugggaucuggccagcugcuuugggauacggucaccgggguggacauggcccuguga

SEQ ID NO: 212147 - RNA, 1401 nt, Artificial Sequence; identical to SEQ ID NO: 211980
  derived and/or modified sequence opt5 from neuraminidase__InfluenzaB__AGX15999

SEQ ID NO: 212148 - RNA, 1401 nt, Artificial Sequence; identical to SEQ ID NO: 211980
  derived and/or modified sequence opt5 from neuraminidase__InfluenzaB__AGX16010

SEQ ID NO: 212149 - RNA, 1401 nt, Artificial Sequence; identical to SEQ ID NO: 211980
  derived and/or modified sequence opt5 from neuraminidase__InfluenzaB__AGX16021

SEQ ID NO: 212150 - RNA, 1401 nt, Artificial Sequence
  derived and/or modified sequence opt5 from neuraminidase__InfluenzaB__AGX16032
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggaaaggaauggacauauaucggcguugacgggccugauucuaaugcucugcuuaaaauuaaguacggagaggccuacaccgacacguaucacuccuacgcgaaaaacauccugcggacacaagaaagcgccuguaauugcauuggcggggauuguuaucucaugaucaccgacggacccgcuuccggcaucucugagugccgcuuucugaagauuagagagggccggaucauuaaggaaaucuucccgacagggcgcgugaaacacaccgaggaauguaccugcggauuugccagcaacaagacaauugagugugcuugcagagauaauuccuacacggccaaacggccuuucgucaaacuuaacguggaaaccgacacagccgagauccgccugaugugcaccgagacauaucucgauacccccagaccuaaugacggcagcaucacggggcccugugaaucugauggagacaagggcuccgggggaauuaagggcggcuuuguucaucagcggauggcuagcaaaaucgggcgcugguacucuagaacaaugagcaagaccaagcggaugggaaugggccuguaugugaaauacgacggggaucccuggaccgacuccgaggcgcuggcccucucuggagucauggugagcauggaggaaccuggcugguacuccuucggguuugaaauuaaggauaaaaagugcgacgugccguguaucggcauugagaugguccacgauggaggcaaaacaaccuggcauagcgcugccacagccaucuauugccugauggggucuggacagcuucugugggacacgguuaccggcguggauauggcucucuga

SEQ ID NO: 212151 - RNA, 1401 nt, Artificial Sequence; identical to SEQ ID NO: 211767
  derived and/or modified sequence opt5 from neuraminidase__InfluenzaB__AGX16043

SEQ ID NO: 212152 - RNA, 1401 nt, Artificial Sequence; identical to SEQ ID NO: 211769
  derived and/or modified sequence opt5 from neuraminidase__InfluenzaB__AGX16054

SEQ ID NO: 212153 - RNA, 1401 nt, Artificial Sequence
  derived and/or modified sequence opt5 from neuraminidase__InfluenzaB__AGX16087
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggacgggaauggacauauaucggcguugacgggccugauucuaaugcucugcuuaagauuaaauacggagaggccuacaccgacacguaucacuccuacgcgaagaacauccugcgcacacaagaaagcgccuguaauugcauuggcggggauuguuaucucaugaucaccgacggacccgcuuccggcaucucugagugcagauuucugaaaauucgggagggccgcaucauuaaggaaaucuucccgacagggagagugaagcacaccgaggaauguaccugcggauuugccagcaacaaaacaauugagugugcuugccgggauaauaacuacacggccaagcgcccuuucgucaaacuuaauguggaaaccgacacagccgagaucagacugaugugcaccgagacauaucucgauacgccccggccuaacgacggcuccaucaccgggcccugugaaagcaauggagauaagggcucugggggaauuaaaggcggcuuuguucaucagcgcauggcuuccaagaucgggagaugguacagccggacaaugucuaaaaccaagagaaugggaaugggccuguaugugaaguacgacggggaccccuggaccgauagcgaggcgcuggcccucuccggagucauggugucuauggaggaaccuggcugguacagcuucggguuugaaauuaaagacaagaaaugcgaugugccguguaucggcauugagaugguccacgacggaggcaagacaaccuggcauuccgcugccacagccaucuauugccugauggggagcggacagcuucugugggauacgguuaccggcguggacauggcucucuga

SEQ ID NO: 212154 - RNA, 1401 nt, Artificial Sequence
  derived and/or modified sequence opt5 from neuraminidase__InfluenzaB__AGX16109
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaaggaauguaaacauuuugcucucacacacuacgccgcgcagccugggggauauuacaacggcacccgggaggaccgcaauaagcugagacaucugaucagcgucaagcucggcaaaauucccacaguggagaacucuaucuuccacauggccgcuugguccgggagcgccugccaugauggacgggaauggaccuauguuggcguggacgggccugauucuaaugcucugcuuaagauuaaauacggagaggccuacacggacacauaucacuccuacgcgaagaacauccugcgcacccaagaaagcgccuguaauugcauuggcggggauuguuaucucaugaucacagacggacccgcuuccggcauuucugagugcagauuucugaaaauccgggagggccgcaucauuaaggaaaucuucccgaccgggagagucaagcacaccgaggaauguacaugcggauuugccagcaacaaaacgauugagugugcuugccgggauaauuccuacaccgccaagcgcccuuucgugaaacuugacguugaaacagauaccgccgagaucagacugaugugcacagagaccuaucucgacacgccccggccuaacgauggcagcauuacagggcccugugaagcuaauggagacaagggcucugggggaaucaaaggcggcuuugugcaucagcgcauggcguccaagaucgggagaugguacagccggaccaugucuaaaaccaagagaaugggaaugggccuguaugucaaguacgacggggaucccuggacagacagcgaggcccuggcucucuccggagugauggugucuauggaggaaccuggcugguacagcuucggguuugaaauuaaagauaagaaaugcgacgucccguguaucggcauugagaugguucacgauggaggcaagaccacauggcauuccgccgccacggcuaucuauugccugauggggagcggacagcuucugugggacaccgugacaggcguggauauggcccucuga

SEQ ID NO: 212155 - RNA, 1401 nt, Artificial Sequence
  derived and/or modified sequence opt5 from neuraminidase__InfluenzaB__AGX16120
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugaccuuccugcuucccgaaccugaguggacguauccccggcuguccuguccuggcagcaccuuucagaaggcccuccugauuucuccccaccgcuucggggaaacaaaaggaaauuccgcuccucuuaucauuagagagccguuuaucgccugcggccccaaggaauguaaacauuucgcucugacccacuacgccgcgcagccugggggauauuacaacggcacacgggaggaccgcaauaagcucagacaucugaucagcgucaagcugggcaaaauucccaccguggagaacucuaucuuucacauggccgcuugguccgggagcgccugccaugauggaaaggaauggacguauauuggcguugacgggccugauucuaaugcucuccugaaaaucaaguacggagaggccuacacagacaccuaucacuccuacgcgaacaauauucuucggacacaggaaagcgccuguaacugcaucggcgggaauuguuaucugaugauuaccgauggauccgcuucuggcaucagcgagugccgcuuccucaaaaucagagagggccggauuaucaaggaaauuuuucccaccgggcgcgugaagcacacagaggaauguacgugcggauucgccuccaacaaaaccaucgagugugcuugcagagacaauagcuacacagccaagcggccguuugucaaacugaacguggaaaccgauacagccgagauucgccuuaugugcaccgagacguaucuggacacaccuagacccgaugacggcucuaucaccgggccuugugaauccaauggaaacaagggcagcgggggaaucaaaggcggcuucguucaucaacggauggcuucuaagauugggcgcugguacagcagaaccauguccaaaacaaagcggaugggaaugggccucuaugugaaguacgauggggaccccuggaccgacucugaugcgcuggcccugagcggagucaugguguccauggaggaacccggcugguacagcuuuggguucgagaucaaagacaagaaaugcgaugugccuuguauuggcaucgaaaugguccacgacggaggcaaggagacauggcauucugcugccacggccauuuauugccucaugggguccggacagcugcuuugggauaccguuacaggcguggacauggcucuguga

SEQ ID NO: 212156 - RNA, 1401 nt, Artificial Sequence; identical to SEQ ID NO: 212155
  derived and/or modified sequence opt5 from neuraminidase__InfluenzaB__AGX16131

SEQ ID NO: 212157 - RNA, 1401 nt, Artificial Sequence; identical to SEQ ID NO: 212155
  derived and/or modified sequence opt5 from neuraminidase__InfluenzaB__AGX16142

SEQ ID NO: 212158 - RNA, 1401 nt, Artificial Sequence
  derived and/or modified sequence opt5 from neuraminidase__InfluenzaB__AGX16153
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacacggggagugacccugcuucugcccgaaccugaguggacauauccccgccucuccuguccuggcagcaccuuccagaaagcccugcuuaucucuccccacagauuuggggaaacgaagggaaauuccgcuccucugauuauccgggagccguucaucgccugcggccccaaagaauguaagcauuuugcucucacccacuacgccgcgcagccugggggauauuacaacggcacacgcgaggacagaaauaaacugcggcaucugauuagcgucaagcucggcaagauccccaccguggagaacucuauuuuccacaugacagccugguccgggagcgcuugccaugauggacgcgaauggaccuauaucggcguugacgggccugauucuaaugcccugcuuaaaauuaaguacggagaggcuuacacggacacauaucacuccuacgccaaaaacauccugagaacccaagaaagcgcguguaauugcauuggcggggauuguuaucucaugaucacagacggacccgccuccggcaucucugagugccgguuucugaagauucgcgagggcagaaucauuaaagaaaucuucccgaccgggcgggugaagcacaccgaggaauguacaugcggauuugcuagcaacaagacgauugagugugccugccgcgauaauuccuacaccgcuaaaagaccuuucgucaaacuuaacguggaaacagacaccgccgagauccggcugaugugcacagagaccuaucucgauacgccccgcccuaaugacggcagcaucacagggcccugugaaucuaacggagauaagggcuccgggggaauuaagggcggcuuuguucaucagagaauggccagcaaaaucgggcggugguacucuagaaccaugagcaagaccaaacgcaugggaaugggccuguaugugaaguacgacggggaccccuggacagauuccgaggcucuggcgcucucuggagucauggugagcauggaggaaccuggcugguacuccuucggguuugaaauuaaggacaaaaagugcgaugugccguguaucggcauugagaugguccacgacggaggcaaaaccacauggcauagcgccgcuacggccaucuauugccugauggggucuggacagcuucugugggauaccguuacaggcguggacauggcccucuga

SEQ ID NO: 212159 - RNA, 1401 nt, Artificial Sequence; identical to SEQ ID NO: 212153
  derived and/or modified sequence opt5 from neuraminidase__InfluenzaB__AGX16164

SEQ ID NO: 212160 - RNA, 1401 nt, Artificial Sequence; identical to SEQ ID NO: 211812
  derived and/or modified sequence opt5 from neuraminidase__InfluenzaB__AGX16197

SEQ ID NO: 212161 - RNA, 1401 nt, Artificial Sequence; identical to SEQ ID NO: 211812
  derived and/or modified sequence opt5 from neuraminidase__InfluenzaB__AGX16208

SEQ ID NO: 212162 - RNA, 1401 nt, Artificial Sequence; identical to SEQ ID NO: 211812
  derived and/or modified sequence opt5 from neuraminidase__InfluenzaB__AGX16219

SEQ ID NO: 212163 - RNA, 1401 nt, Artificial Sequence; identical to SEQ ID NO: 211651
  derived and/or modified sequence opt5 from neuraminidase__InfluenzaB__AGX16230

SEQ ID NO: 212164 - RNA, 1401 nt, Artificial Sequence
  derived and/or modified sequence opt5 from neuraminidase__InfluenzaB__AGX16241
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccacaaaaggagugacccugcuucugcccgaaccugaguggacauaucccagacucuccuguccuggcagcaccuuccagaaggcccugcuuaucucuccccaucgguuuggggaaacgaaaggaaauuccgcuccucugauuauccgcgagccguucaucgccugcggccccaaggaauguaaacacuuugcucucacccauuacgccgcgcagccugggggauauuacaacggcacaagagaggaccggaauaagcugcgccaccugauuagcgucaagcucggcaaaauccccaccguggagaacucuauuuuccauauggccgcuugguccgggagcgccugccacgauggaagagaauggacauauaucggcguugacgggccugauucuaaugcucugcuuaagauuaaauacggagaggccuacaccgacacguaucacuccuacgcgaagaacauccugcggacacaagaaagcgccuguaauugcauuggcggggauuguuaucucaugaucaccgacggacccgcuuccggcaucucugagugccgcuuucugaaaauuagagagggccggaucauuaaggaaaucuucccgacagggcgcgugaagcauaccgaggaauguaccugcggauuugccagcaacaaaacaauugagugugcuugcagagauaauuccuacacggccaagcggccuuucgucaaacuuaacguggaaaccgacacagccgagauccgccugaugugcaccgagacauaucucgauacccccagaccuaaugacggcagcaucauugggcccugugaaucuaacggagauaagggcuccgggggaaucaaaggcggcuuuguucaccagcggauggcuagcaagauugggcgcugguacucuagaacgaugagcaaaacaaagcggaugggaaugggccuguaugugaaguacgacggggaccccuggaccgauuccgaggcgcugacccucucuggagucauggugagcauggaggaaccuggcugguacuccuucggguuugaaaucaaagacaagaaaugcgaugugccguguauuggcaucgagaugguccaugacggaggcaagacaaccuggcacagcgccgcuacagccaucuauugccugauggggucuggacagcuucugugggauacgguuaccggcguggacauggcccucuga

SEQ ID NO: 212165 - RNA, 1401 nt, Artificial Sequence
  derived and/or modified sequence opt5 from neuraminidase__InfluenzaB__AGX16252
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugagugggcuuauccccggcucuccuguccuggcagcaccuuccagaaggcccugcuuaucucuccccaccgcuuuggggaaacaaaaggaaauuccgcuccucugauuaucagagagccguucaucgccugcggccccaccgaauguaagcauuuugcgcucacgcacuacgccgcucagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcgcugcuuaagauuaaauacggagaggccuacacagacaccuaucacuccuacgcuaagaacauccugcggacgcaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacacagaggaauguaccugcggauuugccagcaacaaaaccauugagugugccugcagagauaaucgguacacagcuaagcgcccuuucgucaaacuuaacguggaaacggacaccgcggagaucagacugaugugcacagagaccuaucucgauacaccccggccuaaugacggcuccaucaccgggcccugugaaagcgauggagacaagggcucugggggaauuaaaggcggcuuuguucaucagcgcauggccuccaagaucgggagaugguacagccggacgaugucuaaaacaaagagaaugggaaugggccuguaugugaaguacgacggggaucccuggaccgacagcgaggcucuggcccucuccggagucauggugucuauggaggaaccuggcugguacagcuucggguuugaaauuaaagauaagaaaugcgacgugccguguaucggcauugagaugguccacgauggaggcaagaccacauggcauuccgccgcuaccgccaucuauugccugauggggagcggacagcuucugugggacacaguuacgggcguggauauggcgcucuga

SEQ ID NO: 212166 - RNA, 1401 nt, Artificial Sequence; identical to SEQ ID NO: 211812
  derived and/or modified sequence opt5 from neuraminidase__InfluenzaB__AGX16274

SEQ ID NO: 212167 - RNA, 1401 nt, Artificial Sequence
  derived and/or modified sequence opt5 from neuraminidase__InfluenzaB__AGX16285
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcacgacagggcccugugaaucugauggagacaagggcuccgggggaaucaaaggcggcuuuguucaucagcggauggcgagcaagauugggcgcugguacucuagaaccaugagcaaaaccaagcggaugggaaugggccuguaugugaaguacgacggggaucccuggacagacuccgaggcccuggcucucucuggagucauggugagcauggaggaaccuggcugguacuccuucggguuugaaaucaaagauaagaaaugcgacgugccguguauuggcaucgagaugguccacgauggaggcaagaccacauggcauagcgccgccacggcuauuuauugccugauggggucuggacagcuucugugggacaccguuacaggcguggauauggcccucuga

SEQ ID NO: 212168 - RNA, 1401 nt, Artificial Sequence; identical to SEQ ID NO: 211812
  derived and/or modified sequence opt5 from neuraminidase__InfluenzaB__AGX16296

SEQ ID NO: 212169 - RNA, 1401 nt, Artificial Sequence; identical to SEQ ID NO: 211659
  derived and/or modified sequence opt5 from neuraminidase__InfluenzaB__AGX16307

SEQ ID NO: 212170 - RNA, 1401 nt, Artificial Sequence; identical to SEQ ID NO: 211812
  derived and/or modified sequence opt5 from neuraminidase__InfluenzaB__AGX16329

SEQ ID NO: 212171 - RNA, 1401 nt, Artificial Sequence
  derived and/or modified sequence opt5 from neuraminidase__InfluenzaB__AGX16362
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcgugucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaaaaccaagcggaugggaaugggccuguaugucaaguacgacggggaucccuggaccgacuccgaggcccuggcucucucuggagugauggugagcauggaggaaccuggcugguacuccuucggguuugaaaucaaagauaagaaaugcgacgucccguguauuggcaucgagaugguucacgauggaggcaagacaaccuggcauagcgccgccacagcuauuuauugccugauggggucuggacagcuucugugggacacggugaccggcguggauauggcccucuga

SEQ ID NO: 212172 - RNA, 1401 nt, Artificial Sequence; identical to SEQ ID NO: 211984
  derived and/or modified sequence opt5 from neuraminidase__InfluenzaB__AGX16373

SEQ ID NO: 212173 - RNA, 1401 nt, Artificial Sequence
  derived and/or modified sequence opt5 from neuraminidase__InfluenzaB__AGX16384
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugaagcaucugauuagcgucaagcucggcaaaauccccaccguggagaacucuauuuuccacauggcugccugguccgggagcgcuugccaugauggaaaggaauggacauauaucggcguugacgggccugauucuaaugcccugcuuaaaauuaaguacggagaggcguacaccgacacguaucacuccuacgccaaaaacauccugagaacacaagaaagcgcuuguaauugcauuggcggggauuguuaucucaugaucaccgacggacccgccuccggcaucucugagugccgguuucugaagauucgcgagggcagaaucauuaaggaaaucuucccgacagggcgggugaaacacaccgaggaauguaccugcggauuugcuagcaacaagacaauugagugugccugccgcgauaauuccuacacggccaaaagaccuuucgucaaacuuaacguggaaaccgacacagcugagauccggcugaugugcaccgagacauaucucgauacgccccgcccuaaugacggcagcaucaccgggcccugugaaucugauggagacaagggcuccgggggaauuaagggcggcuuuguucaucagagaauggcgagcaaaaucgggcggugguacucucgcacaaugagcaagaccaagagaaugggaaugggccuguaugugaaauacgacggggaucccuggaccgacuccgaggcccuggcucucucuggagucauggugagcauggaggaaccuggcugguacuccuucggguuugaaauuaaggauaaaaagugcgacgugccguguaucggcauugagaugguccacgauggaggcaaaacaaccuggcauagcgccgccacagcuaucuauugccugauggggucuggacagcuucugugggacacgguuaccggcguggauauggcccucuga

SEQ ID NO: 212174 - RNA, 1401 nt, Artificial Sequence; identical to SEQ ID NO: 211841
  derived and/or modified sequence opt5 from neuraminidase__InfluenzaB__AGX16406

SEQ ID NO: 212175 - RNA, 1401 nt, Artificial Sequence; identical to SEQ ID NO: 211841
  derived and/or modified sequence opt5 from neuraminidase__InfluenzaB__AGX16427

SEQ ID NO: 212176 - RNA, 1401 nt, Artificial Sequence; identical to SEQ ID NO: 211841
  derived and/or modified sequence opt5 from neuraminidase__InfluenzaB__AGX16438

SEQ ID NO: 212177 - RNA, 1401 nt, Artificial Sequence; identical to SEQ ID NO: 211841
  derived and/or modified sequence opt5 from neuraminidase__InfluenzaB__AGX16449

SEQ ID NO: 212178 - RNA, 1401 nt, Artificial Sequence; identical to SEQ ID NO: 211841
  derived and/or modified sequence opt5 from neuraminidase__InfluenzaB__AGX16460

SEQ ID NO: 212179 - RNA, 1401 nt, Artificial Sequence
  derived and/or modified sequence opt5 from neuraminidase__InfluenzaB__AGX16471
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccaagacauaucucgauacccccagaccuaaugacggcagcaucacggggcccugugagucugauggagacaaaggcuccgggggaauuaagggcggcuuuguucaucagcggauggcgagcaaaaucgggcgcugguacucuagaacaaugagcaagacccggagaaugggaaugggccuguaugugaaguacgacggggaucccuggaccgacuccgaagcccuggcucucucuggagucauggugagcauggaggaaccuggcugguacuccuucggguuugagauuaaagauaagaaaugcgacgugccguguaucggcauugaaaugguccacgauggaggcaagacaaccuggcauagcgccgccacagcuaucuauugccugauggggucuggacagcuucugugggacacgguuaccggcguggauauggcccucuga

SEQ ID NO: 212180 - RNA, 1401 nt, Artificial Sequence; identical to SEQ ID NO: 211841
  derived and/or modified sequence opt5 from neuraminidase__InfluenzaB__AGX16482

SEQ ID NO: 212181 - RNA, 1401 nt, Artificial Sequence
  derived and/or modified sequence opt5 from neuraminidase__InfluenzaB__AGX16493
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucguggugagcauggaggaaccuggcugguacuccuucggguuugaaauuaaagauaagaaaugcgacgucccguguaucggcauugagaugguucacgauggaggcaagacaaccuggcauagcgccgccacagcuaucuauugccugauggggucuggacagcuucugugggacacggugaccggcguggauauggcccucuga

SEQ ID NO: 212182 - RNA, 1401 nt, Artificial Sequence; identical to SEQ ID NO: 211640
  derived and/or modified sequence opt5 from neuraminidase__InfluenzaB__AGX16504

SEQ ID NO: 212183 - RNA, 1401 nt, Artificial Sequence; identical to SEQ ID NO: 211640
  derived and/or modified sequence opt5 from neuraminidase__InfluenzaB__AGX16515

SEQ ID NO: 212184 - RNA, 1401 nt, Artificial Sequence
  derived and/or modified sequence opt5 from neuraminidase__InfluenzaB__AGX16548
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaacggguccggaggcaucaagggcggguuuguucaucaacggauggcuagcaaaauuggacgcugguacucuagaaccaugagcaagaccaaacggaugggcauggggcuguaugugaaguacgacggagaccccugggcggauuccgacgcccuggcucucucuggcgucauggugagcauggaggaaccugggugguacuccuucggcuuugaaaucaaggauaaaaagugcgacgugccguguauuggaaucgagaugguccacgauggcgggaaagaaacauggcauagcgccgccaccgcuauuuauugccugaugggaucuggccagcuucugugggacacaguuacggggguggauauggcccucuga

SEQ ID NO: 212185 - RNA, 1401 nt, Artificial Sequence
  derived and/or modified sequence opt5 from neuraminidase__InfluenzaB__AGX16559
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucaagcugugaacagaagcgccacaaaaggagugacccugcuucugccugaacccgaguggacauauccucggcucuccugucccggcagcaccuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcaucucugaaugccgcuuucugaaaauuagagaggggcggaucauuaaggagaucuucccgacaggacgcgugaagcacaccgaagaguguaccugcggcuuugccagcaauaaaacaauugaaugugcuugcagagacaacuccuacacggccaagcggccuuucgucaaacuuaauguggagaccgauacagccgaaauccgccugaugugcaccgagacauaucucgacacccccagaccugaugacgggagcaucacgggacccugugagucuaacggcgauaagggguccggaggcauuaaaggcggguuuguucaucaacggauggcuagcaagaucggacgcugguacucuagaacaaugagcaaaaccaagcggaugggcauggggcuguaugugaaguacgacggagaccccugggcggauuccgacgcccuggcucucucuggcgucauggugagcauggaggaaccugggugguacuccuucggcuuugaaauuagagauaaaaagugcgacgugccguguaucggaauugagaugguccacgauggcgggaaagaaaccuggcauagcgccgccacagcuaucuauugccugaugggaucuggccagcuucugugggacaccguuacagggguggauauggcccucuga

SEQ ID NO: 212186 - RNA, 1401 nt, Artificial Sequence
  derived and/or modified sequence opt5 from neuraminidase__InfluenzaB__AGX16581
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucaagcugugaacagaagcgccacaaaaggagugacccugcuucugccugaacccgaguggacauauccucggcucuccugucccggcagcaccuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcaucucugaaugccgcuuucugaaaauuagagaggggcggaucauuaaggagaucuucccgacaggacgcgugaagcacaccgaagaguguaccugcggcuuugccagcaauaaaacaauugaaugugcuugcagagacaacuccuacacggccaagcggccuuucgucaaacuuaauguggagaccgauacagccgaaauccgccugaugugcaccgagacauaucucgacacccccagaccugaugacgggagcaucacgggacccugugagucuaacggcgauaagggguccggaggcauuaaaggcggguuuguucaucaacggauggcuagcaagaucggacgcugguacucuagaacaaugagcaaaaccaagcggaugggcauggggcuguaugugaaguacgacggagaccccugggcggauuccgacgcccuggcucucucuggcgucauggugagcauggaggaaccugggugguacuccuucggcuuugaaauuaaagauaagaaaugcgacgugccguguaucggaauugagaugguccacgauggcgggaaggaaaccuggcauagcgccgccacagcuaucuauugccugaugggaucuggccagcuucugugggacaccguuacagggguggauauggcccucuga

SEQ ID NO: 212187 - RNA, 1401 nt, Artificial Sequence; identical to SEQ ID NO: 212186
  derived and/or modified sequence opt5 from neuraminidase__InfluenzaB__AGX16592

SEQ ID NO: 212188 - RNA, 1401 nt, Artificial Sequence; identical to SEQ ID NO: 211640
  derived and/or modified sequence opt5 from neuraminidase__InfluenzaB__AGX16603

SEQ ID NO: 212189 - RNA, 1401 nt, Artificial Sequence; identical to SEQ ID NO: 211706
  derived and/or modified sequence opt5 from neuraminidase__InfluenzaB__AGX16614

SEQ ID NO: 212190 - RNA, 1401 nt, Artificial Sequence; identical to SEQ ID NO: 212184
  derived and/or modified sequence opt5 from neuraminidase__InfluenzaB__AGX16625

SEQ ID NO: 212191 - RNA, 1401 nt, Artificial Sequence
  derived and/or modified sequence opt5 from neuraminidase__InfluenzaB__AGX16636
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucaagcugugaacagaagcgccacaaaaggagugacccugcuucugccugaacccgaguggacauauccucggcucuccugucccggcagcaccuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcaucucugaaugccgcuuucugaaaauuagagaggggcggaucauuaaggagaucuucccgacaggacgcgugaagcacaccgaagaguguaccugcggcuuugccagcaauaaaacaauugaaugugcuugcagagacaacuccuacacggccaagcggccuuucgucaaacuuaauguggagaccgauacagccgaaauccgccugaugugcaccgagacauaucucgacacccccagaccugaugacgggagcaucacgggacccugugagucuaacggcgauaagggguccggaggcauuaaaggcggguuuguucaucaacggauggcuagcaagaucggacgcugguacucuagaacaaugagcaaaaccaagcggaugggcauggggcuguaugugaaguacgacggagaccccugggcggauuccgacgcccuggcucucucuggcgucauggugagcauggaggaaccugggugguacuccuucggcuuugaaauuaaagauaagaaaugcgacgugccguguaucggaauugagaugguccacgauggcgggaaggaaaccuggcauagcgccgccacagcuaucuauugccugaugggaucuggccagcuucuguggaacaccguuacagggguggacauggcccucuga

SEQ ID NO: 212192 - RNA, 1401 nt, Artificial Sequence; identical to SEQ ID NO: 211638
  derived and/or modified sequence opt5 from neuraminidase__InfluenzaB__AGX16647

SEQ ID NO: 212193 - RNA, 1401 nt, Artificial Sequence; identical to SEQ ID NO: 212186
  derived and/or modified sequence opt5 from neuraminidase__InfluenzaB__AGX16658

SEQ ID NO: 212194 - RNA, 1401 nt, Artificial Sequence; identical to SEQ ID NO: 211640
  derived and/or modified sequence opt5 from neuraminidase__InfluenzaB__AGX16669

SEQ ID NO: 212195 - RNA, 1401 nt, Artificial Sequence; identical to SEQ ID NO: 211706
  derived and/or modified sequence opt5 from neuraminidase__InfluenzaB__AGX16680

SEQ ID NO: 212196 - RNA, 1401 nt, Artificial Sequence; identical to SEQ ID NO: 211640
  derived and/or modified sequence opt5 from neuraminidase__InfluenzaB__AGX16691

SEQ ID NO: 212197 - RNA, 1401 nt, Artificial Sequence
  derived and/or modified sequence opt5 from neuraminidase__InfluenzaB__AGX16702
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcaagcggggcgaccgcaauaagcugagacaucugaucagcgucaaacucgggaagauuccuaccguggagaacucuaucuuccacauggccgcuugguccggaagcgccugccaugauggcaaagaguggacauauauugggguugacggacccgauaauaacgcucugcuuaagaucaaauacggcgaagccuacaccgacacguaucacucuuacgcgaauaacauucugcggacacaggaguccgccuguaauugcaucgggggaaacuguuaucucaugauuaccgauggcagcgcuuccggcaucucugaaugccgcuuucugaagaucagagaggggcggauuaucaaggagauuuucccgacaggacgcgugaaacacaccgaagaguguaccugcggcuuugccagcaauaagacaaucgaaugugcuugcagagacaacuccuacacggccaaacggccuuucgucaaacuuaauguggagaccgauacagccgaaauucgccugaugugcaccgagacauaucucgacacccccagaccugaugacgggagcaucacgggacccugugagucuaacggcgauaagggguccggaggcaucaagggcggguuuguucaucaacggauggcuagcaaaauuggacgcugguacucuagaacaaugagcaagaccaagcggaugggcauggggcuguaugugaaauacgacggagaccccugggcggauuccgacgcccuggcucucucuggcgucauggugagcauggaggaaccugggugguacuccuucggcuuugaaaucaaggauaaaaagugcgacgugccguguauuggaaucgagaugguccacgauggcgggaaagaaaccuggcauagcgccgccacagcuauuuauugccugaugggaucuggccagcuucugugggacaccguuacagggguggauauggcccucuga

SEQ ID NO: 212198 - RNA, 1401 nt, Artificial Sequence
  derived and/or modified sequence opt5 from neuraminidase__InfluenzaB__AGX16713
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcauuuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcaucucugaaugccgcuuucugaaaauuagagaggggcggaucauuaaggagaucuucccgacaggacgcgugaagcacaccgaagaguguaccugcggcuuugccagcaauaaaacaauugaaugugcuugcagagacaacuccuacacggccaagcggccuuucgucaaacuuaauguggagaccgauacagccgaaauccgccugaugugcaccgagacauaucucgacacccccagaccugaugacgggagcaucacgggacccugugagucuaacggcgauaagggguccggaggcauuaaaggcggguuuguucaucaacggauggcuagcaagaucggacgcugguacucuagaacaaugagcaaaaccaagcggaugggcauggggcuguaugugaaguacgacggagaccccugggcggauuccgacgcccuggcucucucuggcgucauggugagcauggaggaaccugggugguacuccuucggcuuugaaauuagagauaaaaagugcgacgugccguguaucggaauugagaugguccacgauggcgggaaagaaaccuggcauagcgccgccacagcuaucuauugccugaugggaucuggccagcuucugugggacaccguuacagggguggauauggcccucuga

SEQ ID NO: 212199 - RNA, 1401 nt, Artificial Sequence; identical to SEQ ID NO: 211640
  derived and/or modified sequence opt5 from neuraminidase__InfluenzaB__AGX16724

SEQ ID NO: 212200 - RNA, 1401 nt, Artificial Sequence; identical to SEQ ID NO: 212186
  derived and/or modified sequence opt5 from neuraminidase__InfluenzaB__AGX16735

SEQ ID NO: 212201 - RNA, 1401 nt, Artificial Sequence; identical to SEQ ID NO: 212186
  derived and/or modified sequence opt5 from neuraminidase__InfluenzaB__AGX16746

SEQ ID NO: 212202 - RNA, 1401 nt, Artificial Sequence; identical to SEQ ID NO: 211640
  derived and/or modified sequence opt5 from neuraminidase__InfluenzaB__AGX16757

SEQ ID NO: 212203 - RNA, 1401 nt, Artificial Sequence
  derived and/or modified sequence opt5 from neuraminidase__InfluenzaB__AGX16768
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucaagcugugaacagaagcgccacaaaaggagugacccugcuucugccugaacccgaguggacauauccucggcucuccugucccggcagcaccuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcaucucugaaugccgcuuucugaaaauuagagaggggcggaucauuaaggagaucuucccgacaggacgcgugaagcacaccgaagaguguaccugcggcuuugccagcaauaaaacaauugaaugugcuugcagagacaacuccuacacggccaagcggccuuucgucaaacuuaauguggagaccgauacagccgaaauccgccugaugugcaccgagacauaucucgacacccccagaccugaugacgggagcaucacgggacccuguaagucuaacggcgauaaaggguccggaggcauuaagggcggguuuguucaucaacggauggcuagcaaaaucggacgcugguacucuagaacaaugagcaagaccaagcggaugggcauggggcuguaugugaaauacgacggagaccccugggcggauuccgacgcccuggcucucucuggcgucauggugagcauggaggaaccugggugguacuccuucggcuuugagauuaaggauaaaaagugcgacgugccguguaucggaauugaaaugguccacgauggcgggaaagagaccuggcauagcgccgccacagcuaucuauugccugaugggaucuggccagcuucugugggacaccguuacagggguggauauggcccucuga

SEQ ID NO: 212204 - RNA, 1401 nt, Artificial Sequence; identical to SEQ ID NO: 211706
  derived and/or modified sequence opt5 from neuraminidase__InfluenzaB__AGX16779

SEQ ID NO: 212205 - RNA, 1401 nt, Artificial Sequence
  derived and/or modified sequence opt5 from neuraminidase__InfluenzaB__AGX16790
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgggcgcaauaagcugagacaucugaucagcgucaagcucggaaaaauuccuacaguggagaacucuaucuuccacauggccgcuugguccggcagcgccugccaugacgggaaggaguggaccuauauuggaguugauggccccgacaauaacgcucugcuuaaaaucaaguacggggaagccuacacggauacauaucacucuuacgcgaauaacauucugcggacccaggaguccgccuguaauugcaucggaggcaacuguuaucucaugauuacagacggcagcgcuuccgggaucucugaaugccgcuuucugaaaaucagagagggacggauuaucaaggagauuuucccgaccggccgcgugaagcacaccgaagaguguacaugcggguuugccagcaauaaaacgaucgaaugugcuugcagagauaacuccuacaccgccaagcggccuuucgucaaacuuaauguggagacagacaccgccgaaauucgccugaugugcacagagaccuaucucgauacgcccagaccugacgauggaagcaucacaggccccugugagucuaacggggacaagggauccggcggcaucaaagggggauuuguucaucaacggauggcuagcaagauuggccgcugguacucuagaaccaugagcaaaaccaagcggauggggaugggacuguaugugaaguacgauggcgaccccugggcggacuccgaugcccuggcucucucuggggucauggugagcauggaggaaccuggcugguacuccuucggauuugaaaucagagacaaaaagugcgaugugccguguauuggcaucgagaugguccacgacgggggaaaagaaacauggcauagcgccgccaccgcuauuuauugccugaugggcucugggcagcuucugugggauacaguuacgggaguggacauggcccucuga

SEQ ID NO: 212206 - RNA, 1401 nt, Artificial Sequence
  derived and/or modified sequence opt5 from neuraminidase__InfluenzaB__AGX16801
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucaagcugugaacagaagcgccacaaaaggagugacccugcuucugccugaacccgaguggacauauccucggcucuccugucccggcagcaccuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcaucucugaaugccgcuuucugaaaauuagagaggggcggaucauuaaggagaucuucccgacaggacgcgugaagcacaccgaagaguguaccugcggcuuugccagcaauaaaacaauugaaugugcuugcagagacaacuccuacacggccaagcggccuuucgucaaacuuaauguggagaccgauacagccgaaauccgccugaugugcaccgagacauaucucgacacccccagaccuaacgaugggagcaucacgggacccugugagucuaacggcgacaagggguccggaggcauuaaaggcggguuuguucaucaacggauggcuagcaagaucggacgcugguacucuagaacaaugagcaaaaccaagcggaugggcauggggcuguaugugaaguacgauggagaccccugggcggacuccgaugcccuggcucucucuggcgucauggugagcauggaggaaccugggugguacuccuucggcuuugaaauuaaagacaagaaaugcgaugugccguguaucggaauugagaugguccacgacggcgggaaggaaaccuggcauagcgccgccacagcuaucuauugccugaugggaucuggccagcuucugugggauaccguuacagggguggacauggcccucuga

SEQ ID NO: 212207 - RNA, 1401 nt, Artificial Sequence; identical to SEQ ID NO: 211640
  derived and/or modified sequence opt5 from neuraminidase__InfluenzaB__AGX16812

SEQ ID NO: 212208 - RNA, 1401 nt, Artificial Sequence
  derived and/or modified sequence opt5 from neuraminidase__InfluenzaB__AGX16823
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugcugaugggagcaucacaggacccugugagucuaacggcgacaagggguccggaggcaucaaaggcggguuuguucaucaacggauggcgagcaagauuggacgcugguacucuagaaccaugagcaaaaccaagcggaugggcauggggcuguaugugaaguacgauggagaccccugggccgacuccgaugcucuggcccucucuggcgucauggugagcauggaggaaccugggugguacuccuucggcuuugaaaucaaagacaagaaaugcgaugugccguguauuggaaucgagaugguccacgacggcgggaaggaaacauggcauagcgccgcuaccgccauuuauugccugaugggaucuggccagcuucugugggauacaguuacggggguggacauggcgcucuga

SEQ ID NO: 212209 - RNA, 1401 nt, Artificial Sequence; identical to SEQ ID NO: 211640
  derived and/or modified sequence opt5 from neuraminidase__InfluenzaB__AGX16834

SEQ ID NO: 212210 - RNA, 1401 nt, Artificial Sequence
  derived and/or modified sequence opt5 from neuraminidase__InfluenzaB__AGX16845
augcugcccagcaccauccagacacucacgcuguuccuuaccuccggcggggugcugcucucucuguacgucagcgccucccuuucuuaucugcucuacagcgacauucugcugaaguuuuccccuacagagaucaccacaccgaccaugccccucgauugcgcuaacgccucuaauguucaagcggugaacagaagcgcuacaaaaggagugacccugcuucugccugaacccgaguggacguauccucggcucuccugucccggcagcaccuuccagaaggcccugcuugucucuccucaccgcuuuggggaaacaaaaggaaauuccgccccgcugauuaucagagagcccuucauugcuugcggcccuaaggaauguaaacauuuugcccucacccacuacgcugcccagcccgggggauauuacaacggcacacggggcgaccgcaauaagcugagacaucugaucagcgugaagcucgggaaaaucccuaccguugagaacucuauuuuccacauggcggccugguccggaagcgcuugccaugauggcaaggaguggacguauaucgggguggacggacccgauaauaacgcccugcuuaaaauuaaguacggcgaggcuuacacagacaccuaucacucuuacgccaauaacauccugcggacacaggaguccgcguguaauugcauugggggaaacuguuaucucaugaucaccgauggcagcgccuccggcauuucugaaugccgcuuucugaaaaucagagaggggcggaucauuaaggagaucuucccgaccggacgcgucaagcacacagaagaguguacgugcggcuuugcuagcaauaaaaccauugaaugugccugcagagacaacuccuacacagcuaagcggccuuucgugaaacuuaauguugagaccgauacagccgaaauccgccugaugugcaccgagacguaucucgacacacccagaccugaugacgggagcauuaccggacccugugagucuaacggcgauaagggguccggaggcaucaaaggcggguuugugcaucaacggauggccagcaagaucggacgcugguacucuagaaccaugagcaaaacaaagcggaugggcauggggcuguaugucaaguacgacggagaccccugggcugauuccgacgcgcuggcccucucuggcgugauggugagcauggaagaaccugggugguacuccuucggcuuugaaauuaaagauaagaaaugcgacgucccguguaucggaauugagaugguucacgauggcgggaaggaaaccuggcauagcgcugccacagccaucuauugccugaugggaucuggccagcuucugugggacacggugaccgggguggauauggcucucuga

SEQ ID NO: 212211 - RNA, 1401 nt, Artificial Sequence
  derived and/or modified sequence opt5 from neuraminidase__InfluenzaB__AGX16856
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaguuccccucgauugcgccaacgcgucuaaugugcaagcugugaacagaagcgccaccaaaggagucacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacagcggcacccggggcgaccgcaacaagcugagacaucugaucucugugaagcucgggaaaauuccuacaguugaaaauuccaucuuccacauggccgcuuggagcggaucugccugccaugauggcaaggaguggaccuauauugggguggacggacccgauaacaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgucaagcacaccgaagaguguacaugcggcuuugccuccaacaaaacgaucgaaugugcuugcagagacaauagcuacaccgccaagcggccuuucgugaaacuuaacguugagacagauaccgccgaaauucgccugaugugcacagagaccuaucucgacacgcccagaccugaugacgggucuaucacaggacccugugaguccaauggcgauaaggggagcggaggcaucaaaggcggguuugugcaucaacggauggcuucuaagauuggacgcugguacagcagaaccauguccaaaaacaagcggaugggcauggggcuguaugucaaguacgacggagaccccugggcggauucugacgcccuggcucucagcggcgugaugguguccauggaggagccugggugguacagcuucggcuuugaaaucaaagauaagaaaugcgacgucccguguauuggaaucgagaugguucacgauggcgggaaggaaaccuggcauucugccgccacagcuauuuauugccugaugggauccggccagcuucugugggacaccgugacagggguggauauggcccucuga

SEQ ID NO: 212212 - RNA, 1401 nt, Artificial Sequence; identical to SEQ ID NO: 211640
  derived and/or modified sequence opt5 from neuraminidase__InfluenzaB__AGX16867

SEQ ID NO: 212213 - RNA, 1401 nt, Artificial Sequence
  derived and/or modified sequence opt5 from neuraminidase__InfluenzaB__AGX16878
augcugcccagcaccauccagacacucacgcuguuccuuaccuccggcggggugcugcucucucuguacgucagcgccucccuuucuuaucugcucuacagcgacauucugcugaaguuuuccccuacagagcucaccgcuccgacaaugccccuggauugcgccaacgcgucuaauguucaagcugugaacagaagcgccaccaaaggagugacacuucugcucccugaacccgaguggaccuauccucggcuguccugucccggcagcacguuccagaaggcccuucugaucucuccucaccgcuuuggggaaaccaaaggaaauuccgcuccgcucauuaucagagagcccuucauugccugcggcccuaaggaauguaaacauuuugcucugacacacuacgccgcgcagcccgggggauauuacaacggcaagcggggcgaccgcaauaagcugagacaucucaucagcgucaaacuggggaagaucccuaccguggagaacucuauuuuccacauggccgcuugguccggaagcgccugccaugauggcaaagaguggacauauaucgggguugacggacccgauaauaacgcucugcuuaagauuaaauacggcgaagccuacaccgacacguaucacucuuacgcgaauaacauccuccggacacaggaguccgccuguaauugcauugggggaaacuguuaucugaugaucaccgauggcagcgcuuccggcauuucugaaugccgcuuucuuaagaucagagaggggcggaucauuaaggagaucuucccgacaggacgcgugaaacacaccgaagaguguaccugcggcuuugccagcaauaagacaauugaaugugcuugcagagacaacuccuacacggccaaacggccuuucgucaagcugaauguggagaccgauacagccgaaauccgccucaugugcaccgagacauaucuggacacccccagaccugaugacgggagcauuacgggacccugugagucuaacggcgauaacggguccggaggcaucaaaggcggguuuguucaucaacggauggcuagcaagaucggacgcugguacucuagaacaaugagcaaaaccaagcggaugggcauggggcuguaugugaaguacgacggagaccccugggcggauuccgacgcccucgcucugucuggcgucauggugagcauggaggaaccugggugguacuccuucggcuuugaaauuaaagauaagaaaugcgacgugccguguaucggaauugagaugguccacgauggcgggaaggaaaccuggcauagcgccgccacagcuaucuauugccuuaugggaucuggccagcugcucugggacaccguuacagggguggauauggcccuguga

SEQ ID NO: 212214 - RNA, 1401 nt, Artificial Sequence; identical to SEQ ID NO: 212186
  derived and/or modified sequence opt5 from neuraminidase__InfluenzaB__AGX16889

SEQ ID NO: 212215 - RNA, 1401 nt, Artificial Sequence
  derived and/or modified sequence opt5 from neuraminidase__InfluenzaB__AGX16900
augcugcccagcaccauccagacacucacgcuguuccuuaccacaggcggggugcugcucucccuguacgucucugccagccuuuccuaucugcucuacucugacauucugcugaaguuuagcccuaccgagaucauugcuccgacaaugccccucgauugcgccaacgcguccaauguucaagcugugaacagaucugccaccaaaggagugacacugcuucugccugaacccgaguggaccuauccucggcucagcugucccggcuccacguuccagaaggcccugcuuaucagcccucaccgcuuuggggaaaccaaaggaaauucugcuccgcugauuaucagagagcccuucaucgccugcggcccuaaggaauguaaacauuuugcucucacacacuacgccgcgcagcccgggggauauuacaacggcacccggggcgaccgcaauaagcugagacaucugauuuccgucaagcucgggaaaaucccuacaguggagaacagcauuuuccacauggccgcuuggucuggauccgccugccaugauggcaaggaguggaccuauaucgggguugacggacccgauaauaacgcucugcuuaaaauuaaguacggcgaagccuacacggacacauaucacagcuacgcgaauaacauccugcggacccaggagucugccuguaauugcauugggggaaacuguuaucucaugaucacagauggcuccgcuagcggcaucuccgaaugccgcuuucugaaaauuagagaggggcggaucauuaaggagaucuucccgaccggacgcgugaagcacaccgaagaguguacaugcggcuuugccucuaauaaaacgauugaaugugcuugcagagacaacagcuacaccgccaagcggccuuucgucaaacuuaauguggagacagauaccgccgaaauccgccugaugugcacagagaccuaucucgacacgcccagaccugaugacggguccaucacaggacccugugagagcaacggcgauaaggggucuggaggcauuaaaggcggguuuguucaucaacggauggcuuccaagaucggacgcugguacagcagaaccaugucuaaaaccaagcggaugggcauggggcuguaugugaaguacgacggagaccccugggcggauagcgacgcccuggcucucuccggcgucauggugucuauggaggaaccugggugguacagcuucggcuuugaaauuaaagauaagaaaugcgacgugccguguaucggaauugagaugguccacgauggcgggaaggaaacauggcauuccgccgccaccgcuaucuauugccugaugggaagcggccagcuucugugggacacaguuacggggguggauauggcccucuga

SEQ ID NO: 212216 - RNA, 1401 nt, Artificial Sequence
  derived and/or modified sequence opt5 from neuraminidase__InfluenzaB__AGX16911
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugccccuggauugcgccaacgcguccaauguucaagcugugaacagaucugccaccaaaggagugacacuucugcucccugaacccgaguggaccuauccucggcugagcugucccggcuccacguuccagaaggcccuucugauuagcccucaccgcuuuggggaaaccaaaggaaauucugcuccgcucaucauuagagagcccuucaucgccugcggcccuaaggaauguaaacauuuugcucugacacacuacgccgcgcagcccgggggauauuacaacggcacccggggcgaccgcaauaagcugagacaucucaucuccgucaagcuggggaaaauuccuacaguggagaacagcaucuuccacauggccgcuuggucuggauccgccugccaugauggcaaggaguggaccuauauugggguugacggacccgauaauaacgcucugcuuaaaaucaaguacggcgaagccuacacggacacauaucacagcuacgcgaauaacauucuccggacccaggagucugccuguaauugcaucgggggaaacuguuaucugaugauuacagauggcuccgcuagcggcaucuccgaaugccgcuuucuuaaaaucagagaggggcggauuaucaaggagauuuucccgaccggacgcgugaagcacaccgaagaguguacaugcggcuuugccucuaauaaaacgaucgaaugugcuugcagagacaacagcuacaccgccaagcggccuuucgucaaacugaauguggagacagauaccgccgaaauucgccucaugugcacagagaccuaucuggacacgcccagaccugaugacggguccaucacaggacccugugagagcaacggcgauaaggggucuggaggcaucaaaggcggguuuguucaucaacggauggcuuccaagauuggacgcugguacagcagaaccaugucuaaaaccaagcggaugggcauggggcuguaugugaaguacgacggagaccccugggcggauagcgacgcccucgcucuguccggcgucauggugucuauggaggaaccugggugguacagcuucggcuuugaaaucaaagauaagaaaugcgacgugccguguauuggaaucgagaugguccacgauggcgggaaggaaacauggcauuccgccgccaccgcuauuuauugccuuaugggaagcggccagcugcucugggacacaguuacggggguggauauggcccuguga

SEQ ID NO: 212217 - RNA, 1401 nt, Artificial Sequence
  derived and/or modified sequence opt5 from neuraminidase__InfluenzaB__AGX16922
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaaggaauguaaacauuucgcucugacacacuacgccgcgcagcccgggggauauuacaacggcacccggggcgaccgcaauaagcucagacaucugaucagcgucaagcuggggaaaauuccuacaguggagaacucuaucuuucacauggccgcuugguccggaagcgccugccaugauggcaaggaguggaccuauauugggguugacggacccgauaauaacgcucuccugaaaaucaaguacggcgaagccuacacggacacauaucacucuuacgcgaauaacauucuucggacccaggaguccgccuguaauugcaucgggggaaacuguuaucugaugauuacagauggcagcgcuuccggcaucucugaaugccgcuuccucaaaaucagagaggggcggauuaucaaggagauuuuuccgaccggacgcgugaagcacaccgaagaguguacaugcggcuucgccagcaauaaaacgaucgaaugugcuugcagagacaacuccuacaccgccaagcggccuuuugucaaacugaauguggagacagauaccgccgaaauucgccuuaugugcacagagaccuaucuggacacgcccagaccugaugacgggagcaucacaggacccugugagucuaacggcgauaagggguccggaggcaucaaaggcggguucguucaucaacggauggcuagcaagauuggacgcugguacucuagaaccaugagcaaaaccaagcggaugggcauggggcucuaugugaaguacgacggagaccccugggcggauuccgacgcccuggcucugucuggcgucauggugagcauggaggaaccugggugguacuccuuuggcuucgaaaucaaagauaagaaaugcgacgugccguguauuggaaucgagaugguccacgauggcgggaaggaaacauggcauagcgccgccaccgcuauuuauugccucaugggaucuggccagcugcuuugggacacaguuacggggguggauauggcccuguga

SEQ ID NO: 212218 - RNA, 1401 nt, Artificial Sequence
  derived and/or modified sequence opt5 from neuraminidase__InfluenzaB__AGX16933
augcugcccagcaccauccagacacucacgcuguuccuuaccuccggcggggugcugcucucucuguacgucagcgccucccuuucuuaucugcucuacagcgacauucugcugaaguuuuccccuacagagaucaacgcuccgaccaugccccucgauugcgccaaugcgucuaacguucaagcugugaauagaagcgccacaaaaggagugacccugcuucugccugaacccgaguggacauauccucggcucuccugucccggcagcaccuuccagaaggcccugcuuauuucuccucaccgcuuuggggaaacgaaaggaaacuccgcuccgcugaucauuagagagcccuucaucgccugcggcccuaaggaauguaaacauuuugcucucacccacuacgccgcgcagcccgggggauauuacaauggcacacggggcgaccgcaacaagcugagacaucugaucagcgucaagcucgggaaaauuccuaccguggaaaauucuaucuuccacauggccgcuugguccggaagcgccugccaugauggcaaggaguggacauauauugggguugacggacccgauaacaaugcucugcuuaaaaucaaguacggcgaagccuacaccgacacguaucacucuuacgcgaacaauauucugcggacacaggaguccgccuguaacugcaucgggggaaauuguuaucucaugauuaccgauggcagcgcuuccggcaucucugaaugccgcuuucugaaaaucagagaggggcggauuaucaaggagauuuucccgacaggacgcgugaagcacaccgaagaguguaccugcggcuuugccagcaacaaaacaaucgaaugugcuugcagagacaauuccuacacggccaagcggccuuucgucaaacuuaacguggagaccgauacagccgaaauucgccugaugugcaccgagacauaucucgacacccccagaccugaugacgggagcaucacgggacccugugagucuaacggcgauaagggguccggaggcaucaaaggcggguuuguucaucaacggauggcuagcaagauuggacgcugguacucuagaacaaugagcaaaaccaagcggaugggcauggggcuguaugugaaguacgacggagaccccugggcggauuccgacgcccuggcucucucuggcgucauggugagcauggaggagccugggugguacuccuucggcuuugaaaucaaagauaagaaaugcgacgugccguguauuggaaucgagaugguccacgauggcgggaaggaaaccuggcauagcgccgccacagcuauuuauugccugaugggaucuggccagcuucugcucgacaccguuacagggguggauauggcccuguga

SEQ ID NO: 212219 - RNA, 1401 nt, Artificial Sequence
  derived and/or modified sequence opt5 from neuraminidase__InfluenzaB__AGX16944
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacagcggcacccggggcgaccgcaacaagcugagacaucugaucucugucaagcucgggaaaauuccuacaguggaaaauuccaucuuccacauggccgcuuggagcggaucugccugccaugauggcaaggaguggaccuauauugggguugacggacccgauaacaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacccugugaguccaauggcgauaaggggagcggaggcaucaaaggcggguuuguucaucaacggauggcuucuaagauuggacgcugguacagcagaaccauguccaaaaacaagcggaugggcauggggcuguaugugaaguacgacggagaccccugggcggauucugacgcccuggcucucagcggcgucaugguguccauggaggagccugggugguacagcuucggcuuugaaaucaaagauaagaaaugcgacgugccguguauuggaaucgagaugguccacgauggcgggaaggaaaccuggcauucugccgccacagcuauuuauugccugaugggauccggccagcuucugugggacaccguuacagggguggauauggcccucuga

SEQ ID NO: 212220 - RNA, 1401 nt, Artificial Sequence; identical to SEQ ID NO: 211640
  derived and/or modified sequence opt5 from neuraminidase__InfluenzaB__AGX16955

SEQ ID NO: 212221 - RNA, 1401 nt, Artificial Sequence; identical to SEQ ID NO: 211638
  derived and/or modified sequence opt5 from neuraminidase__InfluenzaB__AGX16966

SEQ ID NO: 212222 - RNA, 1401 nt, Artificial Sequence; identical to SEQ ID NO: 211640
  derived and/or modified sequence opt5 from neuraminidase__InfluenzaB__AGX16977

SEQ ID NO: 212223 - RNA, 1401 nt, Artificial Sequence; identical to SEQ ID NO: 211640
  derived and/or modified sequence opt5 from neuraminidase__InfluenzaB__AGX16988

SEQ ID NO: 212224 - RNA, 1401 nt, Artificial Sequence; identical to SEQ ID NO: 212184
  derived and/or modified sequence opt5 from neuraminidase__InfluenzaB__AGX16999

SEQ ID NO: 212225 - RNA, 1401 nt, Artificial Sequence; identical to SEQ ID NO: 211640
  derived and/or modified sequence opt5 from neuraminidase__InfluenzaB__AGX17010

SEQ ID NO: 212226 - RNA, 1401 nt, Artificial Sequence; identical to SEQ ID NO: 212186
  derived and/or modified sequence opt5 from neuraminidase__InfluenzaB__AGX17021

SEQ ID NO: 212227 - RNA, 1401 nt, Artificial Sequence
  derived and/or modified sequence opt5 from neuraminidase__InfluenzaB__AGX17032
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucugacguucaagcugugaauagaagcgccaccaaaggagugacacugcuucugccugaacccgaguggaccuauccucggcucuccugucccggcagcacguuccagaaggcccugcuuauuucuccucaccgcuuuggggaaaccaaaggaaacuccgcuccgcugaucauuagagagcccuucaucgccugcggcccuaaggaauguaaacauuuugcucucacacacuacgccgcgcagcccgggggauauuacaaucggacccgcggcgauagaaacaagcugcggcaucugaucagcgucaagcucggcaaaauuccuacaguggaaaauucuaucuuccacauggccgcuugguccgggagcgccugccaugacggaaaggaguggaccuauauuggcguugaugggcccgacaacaaugcucugcuuaaaaucaaguacggagaagccuacacggauacauaucacucuuacgcgaacaauauucugcgcacccaggaguccgccuguaacugcaucggcgggaauuguuaucucaugauuacagacggaagcgcuuccggcaucucugaaugcagauuucugaaaauccgggagggccgcauuaucaaggagauuuucccgaccgggagagugaagcacaccgaagaguguacaugcggauuugccagcaacaaaacgaucgaaugugcuugccgggauaauuccuacaccgccaagcgcccuuucgucaaacuuaacguggagacagacaccgccgaaauuagacugaugugcacagagaccuaucucgauacgccccggccugacgauggcagcaucacagggcccugugagucuaauggagacaagggcuccgggggaaucaaaggcggcuuuguucaucaacgcauggcuagcaagauugggagaugguacucucggaccaugagcaaaaccaagagaaugggaaugggccuguaugugaaguacgacggggaucccugggcggacuccgaugcccuggcucucucuggagucauggugagcauggaggagccuggcugguacuccuucggguuugaaaucaaagacaagaaaugcgaugugccguguauuggcaucgagaugguccacgacggaggcaaggaaacauggcauagcgccgccaccgcuauuuauugccugauggggucuggacagcuucugugggauacaguuacgggcguggacauggcccucuga

SEQ ID NO: 212228 - RNA, 1401 nt, Artificial Sequence; identical to SEQ ID NO: 211638
  derived and/or modified sequence opt5 from neuraminidase__InfluenzaB__AGX17043

SEQ ID NO: 212229 - RNA, 1401 nt, Artificial Sequence
  derived and/or modified sequence opt5 from neuraminidase__InfluenzaB__AGX17054
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaacgggaauggaggcaucaagggcggguuuguucaucaacggauggcuuccaaaauuggacgcugguacagcagaaccaugucuaagaccaaacggaugggcauggggcuguaugugaaguacgacggagaccccugggcggauagcgacgcccuggcucucuccggcgucauggugucuauggaggaaccugggugguacagcuucggcuuugaaaucaaggauaaaaagugcgacgugccguguauuggaaucgagaugguccacgauggcgggaaagaaacauggcauuccgccgccaccgcuauuuauugccugaugggaagcggccagcuucugugggacacaguuacggggguggauauggcccucuga

SEQ ID NO: 212230 - RNA, 1401 nt, Artificial Sequence
  derived and/or modified sequence opt5 from neuraminidase__InfluenzaB__AGX17065
augcugcccagcaccauccagacacucacgcuguuccuuaccuccggcggggugcugcucucucuguacgucagcgcccuucuguccuaucuccuguacucugacauucugcucaaguuuagcccuacaaaaaucauugcuccgaccacaucccuggauucugccaacgcgagcaauuuccaagcuguuaaccacuccgccaccaaggagaugacauuucuucugcccgaaccugaguggaccuaucccagacucagcugccagggaucuacguuccagaaagcccugcuuaucuccccucaucgguuuggcgaagcuaaggggaauagcgcuccccugauuauccgcgagccuuucaucgccuguggaccgaaagaaugcaagcacuuugcccucacccauuacgcggcccagcccggcggguauuacaacggaacaagagaggaccggaauaagcugcgccaccugauuucugugaaccucggcaaaaucccuaccguggaaaauuccauuuuccauauggcugccuggagcggcucugcuugucacgaugggagagaauggacauauaucggagucgacggccccgauuccaacgcccugauuaagaucaaauacggggaggcguacaccgacacguaucacagcuacgccaauaacauucuucggacacaagaauccgcuugcaauuguaucggaggcgauugcuaucugaugaucaccgacgggucugccagcggaauuuccaagugucgcuuucucaaaaucagagagggccggauuaucaaggagauuuucccuacaggccgcguggaacauaccgaggaaugcaccuguggguuugcuagcaacaagacaaucgagugcgccuguagagauaauucuuacacggccaaacggcccuucguuaagcugaacguggaaaccgacacagcugagauccgccuuaugugcaccgagacauaucuggauaccccgagaccugacgauggauccauuacgggccccugcgaaagcaauggggacaaaggaucuggcgggaucaagggaggcuuuguccaccagcggauggcgagcaaaauuggccgcugguacuccagaacaaucucuaagaccaaacggauggggauggagcucuaugugaaguacgacggagauccuuggaccgacagcgaugcccuggcucccuccggcguuauggugagcauugaggagcccgggugguacucuuucggauucgaaaucaaggacaaaaagugugaugucccuugcaucggcauugagauggugcaugacgggggcaaaacaaccuggcacuccgccgccacagcuaucuauugucugaugggaagcggccagcuccugugggauacggugaccggggucgacauggcccuuuga

SEQ ID NO: 212231 - RNA, 1401 nt, Artificial Sequence
  derived and/or modified sequence opt5 from neuraminidase__InfluenzaB__AGX17076
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccuggcucucucuggcgucauggugagcauggaggaaccugggugguacuccuucggcuuugaaaucagagauaaaaagugcgacgugccguguauuggaaucgagauuguccacgauggcgggaaagaaacauggcauagcgccgccaccgcuaucuauugccugaugggaucuggccagcuucugugggacacaguuacggggguggauauggcccucuga

SEQ ID NO: 212232 - RNA, 1401 nt, Artificial Sequence; identical to SEQ ID NO: 212186
  derived and/or modified sequence opt5 from neuraminidase__InfluenzaB__AGX17087

SEQ ID NO: 212233 - RNA, 1401 nt, Artificial Sequence; identical to SEQ ID NO: 212186
  derived and/or modified sequence opt5 from neuraminidase__InfluenzaB__AGX17098

SEQ ID NO: 212234 - RNA, 1401 nt, Artificial Sequence; identical to SEQ ID NO: 212186
  derived and/or modified sequence opt5 from neuraminidase__InfluenzaB__AGX17109

SEQ ID NO: 212235 - RNA, 1401 nt, Artificial Sequence; identical to SEQ ID NO: 212186
  derived and/or modified sequence opt5 from neuraminidase__InfluenzaB__AGX17120

SEQ ID NO: 212236 - RNA, 1401 nt, Artificial Sequence; identical to SEQ ID NO: 211638
  derived and/or modified sequence opt5 from neuraminidase__InfluenzaB__AGX17131

SEQ ID NO: 212237 - RNA, 1401 nt, Artificial Sequence; identical to SEQ ID NO: 211640
  derived and/or modified sequence opt5 from neuraminidase__InfluenzaB__AGX17142

SEQ ID NO: 212238 - RNA, 1401 nt, Artificial Sequence
  derived and/or modified sequence opt5 from neuraminidase__InfluenzaB__AGX17153
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucaucggacccugugagucuaacggcgauaagggguccggaggcauuaaaggcggguuuguucaucaacggauggcuagcaagaucggacgcugguacucuagaacaaugagcaaaaccaagcggaugggcauggggcuguaugugaaguacgacggagaccccugggcggauuccgacgcccuggcucucucuggcgucauggugagcauggaggaaccugggugguacuccuucggcuuugaaauuaaagauaagaaaugcgacgugccguguaucggaauugagaugguccacgauggcgggaaggaaaccuggcauagcgccgccacagcuaucuauugccugaugggaucuggccagcuucugugggacaccguuacagggguggauauggcccucuga

SEQ ID NO: 212239 - RNA, 1401 nt, Artificial Sequence; identical to SEQ ID NO: 212186
  derived and/or modified sequence opt5 from neuraminidase__InfluenzaB__AGX17164

SEQ ID NO: 212240 - RNA, 1404 nt, Artificial Sequence
  derived and/or modified sequence opt5 from neuraminidase__InfluenzaB__AGX17175
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugcucccugaacccgaguggaccuauccucggcuguccugucccggcagcacguuccagaaggcccuucugauuucuccucaccgcuuuggggaaaccaaaggaaauuccgcuccgcucaucauuagagagcccuucaucgccugcggcccuaaggaauguaaacauuuugcucugacacacuacgccgcgcagcccgggggauauuacaacggcacccggggcgaccgcaauaagcugagacaucucaucagcgucaagcuggggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucuccggacccaggaguccgccuguaauugcaucgggggaaacuguuaucugaugauuacagauggcagcgcuuccggcaucucugaaugccgcuuucuuaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacugaauguggagacagauaccgccgaaauucgccucaugugcacagagaccuaucuggacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccucgcucugucuggcgucauggugagcauggaggaaccugggugguacuccuucggcuuugaaaucagagauaaaaagugcgacgugccguguauuggaaucgagaugguccacgauggcgggaaagaaacauggcauagcgccgccaccgcuauuuauugccuuaugggaucuggccagcugcucugggacacaguuacggggguggauauggcccuguga

SEQ ID NO: 212241 - RNA, 1401 nt, Artificial Sequence
  derived and/or modified sequence opt5 from neuraminidase__InfluenzaB__AGX17186
augcugcccagcaccauccagacacucacgcuguuccuuaccuccggcggggugcugcucucucuguacgucagcgccucccuuucuuaucugcucuacagcgacauucugcugaaguuuuccccuacagagaucaccacaccgaccaugccccucgauugcgcuaacgccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaaggaauguaaacauuuugcccucacccacuacgcugcccagcccgggggauauuacaacggcacacggggcgaccgcaauaagcugagacaucugaucagcgucaagcucgggaaaauuccuaccguggagaacucuaucuuccacauggcggccugguccggaagcgcuugccaugauggcaaggaguggacguauauugggguugacggacccgauaauaacgcccugcuuaaaaucaaguacggcgaggcuuacacagacaccuaucacucuuacgccaauaacauucugcggacacaggaguccgcguguaauugcaucgggggaaacuguuaucucaugauuaccgauggcagcgccuccggcaucucugaaugccgcuuucugaaaaucagagaggggcggauuaucaaggagauuuucccgaccggacgcgugaaguacacagaagaguguacgugcggcuuugcuagcaauaaaaccaucgaaugugccugcagagacaacuccuauacagcuaagcggccuuucgucaaacuuaauguggagaccgauacagccgaaauucgccugaugugcaccgagacguaccucgacacacccagaccugaugacgggagcaucaccggacccugugagucuaacggcgauaagggguccggaggcaucaaaggcggguuuguucaccaacggauggccagcaagauuggacgcugguauucuagaaccaugagcaaaacacggagaaugggcauggggcuguacgugaaguacgacggagaccccugggcugauuccgacgcgcuggcccucucuggcgucauggugagcauggaagaaccugggugguauuccuucggcuuugaaaucaaggauaaaaagugcgacgugccguguauuggaaucgagaugguccaugauggcgggaaagaaaccuggcacagcgcugccacagccauuuacugccugaugggaucuggccagcuucugugggacacgguuaccgggguggauauggcucucuga

SEQ ID NO: 212242 - RNA, 1401 nt, Artificial Sequence; identical to SEQ ID NO: 212217
  derived and/or modified sequence opt5 from neuraminidase__InfluenzaB__AGX17197

SEQ ID NO: 212243 - RNA, 1401 nt, Artificial Sequence
  derived and/or modified sequence opt5 from neuraminidase__InfluenzaB__AGX17208
augcugcccagcaccauccagacacucacgcuguuccuuaccuccggcggggugcugcucucucuguacgucagcgccucccuuucuuaucugcucuacagcgacauucugcugaaguuuuccccuacagagaucaccacaccgaccaugccccucgauugcgcuaacgccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaaggaauguaaacauuuugcccucacccacuacgcugcccagcccgggggauauuacaacggcacacggggcgaccgcaauaagcugagacaucugaucagcgucaagcucgggaaaauuccuaccguggagaacucuaucuuccacauggcggccugguccggaagcgcuugccaugauggcaaggaguggacguauauugggguugacggacccgauaauaacgcccugcuuaaaaucaaguacggcgaggcuuacacagacaccuaucacucuuacgccaauaacauucugcggacacaggaguccgcguguaauugcaucgggggaaacuguuaucucaugauuaccgauggcagcgccuccggcaucucugaaugccgcuuucugaaaaucagagaggggcggauuaucaaggagauuuucccgaccggacgcgugaagcacacagaagaguguacgugcggcuuugcuagcaauaaaaccaucgaaugugccugcagagacaacuccuacacagcuaagcggccuuucgucaaacuuaauguggagaccgauacagccgaaauucgccugaugugcaccgagacguaucucgacacacccagaccugaugacgggagcaucaccggacccugugagucuaacggcgauaagggguccggaggcaucaaaggcggguuuguucaucaacggauggccagcaagauuggacgcugguacucuagaaccaugagcaaaacacggagaaugggcauggggcuguaugugaaguacgacggagaccccugggcugauuccgacgcgcuggcccucucuggcgucauggugagcauggaagaaccugggugguacuccuucggcuuugaaaucaaggauaaaaagugcgacgugccguguauuggaaucgagaugguccacgauggcgggaaagaaaccuggcauagcgcugccacagccauuuauugccugaugggaucuggccagcuucugugggacacgguuaccgggguggauauggcucucuga

SEQ ID NO: 212244 - RNA, 1401 nt, Artificial Sequence; identical to SEQ ID NO: 212186
  derived and/or modified sequence opt5 from neuraminidase__InfluenzaB__AGX17219

SEQ ID NO: 212245 - RNA, 1401 nt, Artificial Sequence; identical to SEQ ID NO: 211640
  derived and/or modified sequence opt5 from neuraminidase__InfluenzaB__AGX17230

SEQ ID NO: 212246 - RNA, 1401 nt, Artificial Sequence; identical to SEQ ID NO: 212186
  derived and/or modified sequence opt5 from neuraminidase__InfluenzaB__AGX17241

SEQ ID NO: 212247 - RNA, 1401 nt, Artificial Sequence
  derived and/or modified sequence opt5 from neuraminidase__InfluenzaB__AGX17252
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacucgaguggaccuauccccggcuguccuguccuggcagcacguuccagaaggcccuucugauuucuccccaccgcuuuggggaaaccaaaggaaauuccgcuccucucaucauuagagagccguucaucgccugcggccccaaggaauguaaacauuuugcucugacauacuaugccgcgcagccugggggauacuauaacggcacccggggcgaccgcaauaagcugagacaccucaucagcgucaagcuggggaaaauucccacaguggagaacucuaucuuccauauggccgcuugguccggaagcgccugccacgauggcaaggaguggaccuacauugggguugacggaccugauaauaacgcucugcuuaaaaucaaguacggcgaagccuauacggacacauaccauucuuaugcgaauaacauucuccggacccaggaguccgccuguaauugcaucgggggaaacuguuaccugaugauuacagauggcagcgcuuccggcaucucugaaugccgcuuucuuaaaaucagagaggggcggauuaucaaggagauuuuccccaccggacgcgugaagcacaccgaagaguguacaugcggcuuugccagcaauaaaacgaucgaaugugcuugcagagacaacuccuauaccgccaagcggccguucgucaaacugaauguggagacagauaccgccgaaauucgccucaugugcacagagaccuaccuggacacgccuagacccgcugaugggagcaucacaggaccuugugagucuaacggcgacaagggguccggaggcaucaaaggcggguuuguucaccaacggauggcgagcaagauuggacgcugguauucuagaaccaugagcaaaaccaagcggaugggcauggggcuguacgugaaguacgauggagaccccugggccgacuccgaugcucucgcccugucuggcgucauggugagcauggaggaacccgggugguauuccuucggcuuugaaaucaaagacaagaaaugcgaugugccuuguauuggaaucgagaugguccaugacggcgggaaggaaacauggcacagcgccgcuaccgccauuuacugccuuaugggaucuggccagcugcucugggauacaguuacggggguggacauggcgcuguga

SEQ ID NO: 212248 - RNA, 1401 nt, Artificial Sequence
  derived and/or modified sequence opt5 from neuraminidase__InfluenzaB__AGX17263
augcugcccagcaccauccagacacucacgcuguuccuuaccuccggcggggugcugcucucucuguacgucagcgccucccuuucuuaucugcucuacagcgacauucugcugaagcucuccccuacagagaucaccgcuccgacaaugccccuggauugcgccaacgcgucuaauguucaagcugugaacagaagcgccaccaaaggagugacacuucugcucccugaacccgaguggaccuauccucggcuguccugucccggcagcacguuucagaaggcccuucugauuucuccucaccgcuucggggaaaccaaaggaaauuccgcuccgcucaucauuagagagcccuuuaucgccugcggcccuaaggaauguaaacauuucgcucugacacacuacgccgcgcagcccgggggauauuacaacggcacccggggcgaccgcaauaagcugagacaucucaucagcgucaagcuggggaaaauuccuacaguggagaacucuaucuuucacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucuccggacccaggaguccgccuguaauugcaucgggggaaacuguuaucugaugauuacagauggcagcgcuuccggcaucucugaaugccgcuuccuuaaaaucagagaggggcggauuaucaaggagauuuuuccgaccggacgcgugaagcacaccgaagaguguacaugcggcuucgccagcaauaaaacgaucgaaugugcuugcagagacaacuccuacaccgccaagcggccuuuugucaaacugaauguggagacagauaccgccgaaauucgccucaugugcacagagaccuaucuggacacgcccagaccugaugacgggagcaucacaggacccugugagucuaacggcgauaagggguccggaggcaucaaaggcggguucguucaucaacggauggcuagcaagauuggacgcugguacucuagaaccaugagcaaaaccaagcggaugggcauggggcuguaugugaaguacgacggagaccccugggcggauuccgacgcccucgcucugucuggcgucauggugagcauggaggaaccugggugguacuccuuuggcuucgaaaucaaagauaagaaaugcgacgugccguguauuggaaucgagaugguccacgauggcgggaaggaaacauggcauagcgccgccaccgcuauuuauugccuuaugggaucuggccagcugcucugggacacaguuacggggguggauauggcccuguga

SEQ ID NO: 212249 - RNA, 1401 nt, Artificial Sequence
  derived and/or modified sequence opt5 from neuraminidase__InfluenzaB__AGX17274
augcugcccagcaccauccagacacucacgcuguuccuuaccuccggcggggugcugcucucucuguacgucagcgccucccuuucuuaucugcucuacagcgacauucugcugaaguuuuccccuacagagaucaacgcuccgaccaugccccucgauugcgccaaugcgucuaacguucaagcugugaauagaagcgccacaaaaggagugacccugcuucugccugaacccgaguggacauauccucggcucuccugucccggcagcaccuuccagaaggcccugcuuauuucuccucaccgcuuuggggaaacgaaaggaaacuccgcuccgcugaucauuagagagcccuucaucgccugcggcccuaaggaauguaaacauuuugcucucacccacuacgccgcgcagcccgggggauauuacaauggcacacggggcgaccgcaacaagcugagacaucugaucagcgucaagcucgggaaaauuccuaccguggaaaauucuaucuuccacauggccgcuugguccggaagcgccugccaugauggcaaggaguggacauauauugggguugacggacccgauaacaaugcucugcuuaaaaucaaguacggcgaagccuacaccgacacguaucacucuuacgcgaacaauauucugcggacacaggaguccgccuguaacugcaucgggggaaauuguuaucucaugauuaccgauggcagcgcuuccggcaucucugaaugccgcuuucugaaaaucagagaggggcggauuaucaaggagauuuucccgacaggacgcgugaagcacaccgaagaguguaccugcggcuuugccagcaacaaaacaaucgaaugugcuugcagagacaauuccuacacggccaagcggccuuucgucaaacuuaacguggagaccgauacagccgaaauucgccugaugugcaccgagacauaucucgacacccccagaccugaugacgggagcaucacgggacccugugagucuaacggcgauaagggguccggaggcaucaaaggcggguuuguucaucaacggauggcuagcaagauuggacgcugguacucuagaacaaugagcaaaaccaagcggaugggcauggggcuguaugugaaguacgacggagaccccugggcggauuccgacgcccuggcucucucuggcgucauggugagcauggaggagccugggugguacuccuucggcuuugaaaucaaagauaagaaaugcgacgugccguguauuggaaucgagaugguccacgauggcgggaaggaaaccuggcauagcgccgccacagcuauuuauugccugaugggaucuggccagcuucugugggacaccguuacagggguggauauggcccucuga

SEQ ID NO: 212250 - RNA, 1401 nt, Artificial Sequence
  derived and/or modified sequence opt5 from neuraminidase__InfluenzaB__AGX17285
augcugcccagcaccauccagacacucacgcuguuccuuaccuccggcggggugcugcucucucuguacaugagcgccucccuuucuuaucugcucuacagcgacauucugcugaaguuuuccccuacagagaucaccgcuccgacaaugccccucgauugcgccaacgcgucuaauguccaagcuguuaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgugaagcucgggaaaauuccuacagucgagaacucuaucuuccacauggccgcuugguccggaagcgccugccaugauggcaaggaguggaccuauauugggguggacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcguuaagcacaccgaagaguguacaugcggcuuugccagcaauaaaacgaucgaaugugcuugcagagacaacuccuacaccgccaagcggccuuucgugaaacuuaaugucgagacagauaccgccgaaauucgccugaugugcacagagaccuaucucgacacgcccagaccugaugacgggagcaucacaggacccugugagucuaacggcgauaagggguccggaggcaucaaaggcggguuugugcaucaacggauggcuagcaagauuggacgcugguacucuagaaccaugagcaaaaccaagcggaugggcauggggcuguauguuaaguacgacggagaccccugggcggauuccgacgcccuggcucucucuggcgugauggucagcauggaggaaccugggugguacuccuucggcuuugaaaucaaagauaagaaaugcgacgugccguguauuggaaucgagauggugcacgauggcgggaaggaaacauggcauagcgccgccaccgcuauuuauugccugaugggaucuggccagcuucugugggacacagucacggggguugauauggcccucuga

SEQ ID NO: 212251 - RNA, 1401 nt, Artificial Sequence
  derived and/or modified sequence opt5 from neuraminidase__InfluenzaB__AGX17296
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaagcuaaaggaaauuccgccccgcugaucauuagagagcccuucaucgcuugcggcccuaaggaauguaaacauuuugcccucacccacuacgcggcccagcccgggggauauuacaacggcacacggggcgaccgcaauaagcugagacaucugaucagcgucaagcucgggaaaauuccuaccguggagaacucuaucuuccacauggcugccugguccggaagcgcuugccaugauggcaaggaguggacauauauugggguugacggacccgauaauaacgcccugcuuaaaaucaaguacggcgaagcguacaccgacacguaucacucuuacgccaauaacauucugcggacacaggaguccgcuuguaauugcaucgggggaaacuguuaucucaugauuaccgauggcagcgccuccggcaucucugaaugccgcuuucugaaaaucagagaggggcggauuaucaaggagauuuucccgacaggacgcgugaagcacaccgaagaguguaccugcggcuuugcuagcaauaaaacaaucgaaugugccugcagagacaacuccuacacggccaagcggccuuucgucaaacuuaauguggagaccgauacagcugaaauucgccugaugugcaccgagacauaucucgacacccccagaccugaugacgggagcaucacgggacccugugagucuaacggcgauaagggguccggaggcaucaaaggcggguuuguucaucaacggauggcgagcaagauuggacgcugguacucuagaacaaugagcaaaaccaagcggaugggcauggggcuguaugugaaguacgacggagaccccugggccgauuccgacgcucuggcccucucuggcgucauggugagcauggaggaaccugggugguacuccuucggcuuugaaaucaaagauaagaaaugcgacgugccguguauuggaaucgagaugguccacgauggcgggaaggaaaccuggcauagcgccgcuacagccauuuauugccugaugggaucuggccagcuucugugggacaccguuacagggguggauauggcgcucuga

SEQ ID NO: 212252 - RNA, 1401 nt, Artificial Sequence; identical to SEQ ID NO: 212184
  derived and/or modified sequence opt5 from neuraminidase__InfluenzaB__AGX17307

SEQ ID NO: 212253 - RNA, 1401 nt, Artificial Sequence; identical to SEQ ID NO: 211638
  derived and/or modified sequence opt5 from neuraminidase__InfluenzaB__AGX17318

SEQ ID NO: 212254 - RNA, 1401 nt, Artificial Sequence
  derived and/or modified sequence opt5 from neuraminidase__InfluenzaB__AGX17329
augcugcccagcaccauccagacacucacgcuguuccuuaccuccggcggggugcugcucucucuguacgucagcgccucccuuucuuaucugcucuacagcgacaugcugcugaaguuuuccccuacagagauuaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuaucucuccucaccgcuuuggggaaaccaaaggaaauuccgcuccgcugauuaucagagagcccuucauugccugcggcccuaaggaauguaaacauuuugcucucacacacuacgccgcgcagcccgggggauauuacagcggcacccggggcgaccgcaacaagcugagacaucugaucucugucaagcucgggaaaaucccuacaguggaaaauuccauuuuccacauggccgcuuggagcggaucugccugccaugauggcaaggaguggaccuauaucgggguugacggacccgauaacaaugcucugcuuaaaauuaaguacggcgaagccuacacggacacauaucacuccuacgcgaacaauauccugcggacccaggagagcgccuguaacugcauugggggaaauuguuaucucaugaucacagauggcuccgcuucuggcauuagcgaaugccgcuuucugaaaaucagagaggggcggaucauuaaggagaucuucccgaccggacgcgugaagcacaccgaagaguguacaugcggcuuugccuccaacaaaacgauugaaugugcuugcagagacaauagcuacaccgccaagcggccuuucgucaaacuuaacguggagacagauaccgccgaaauccgccugaugugcacagagaccuaucucgacacgcccagaccugaugacgggucuauuacaggacccugugaguccaauggcgauaaggggagcggaggcaucaaaggcggguuuguucaucaacggauggcuucuaagaucggacgcugguacagcagaaccauguccaaaaacaagcggaugggcauggggcuguaugugaaguacgacggagaccccugggcggauucugacgcccuggcucucagcggcgucaugguguccauggaggagccugggugguacagcuucggcuuugaaauuaaagauaagaaaugcgacgugccguguaucggaauugagaugguccacgauggcgggaaggaaaccuggcauucugccgccacagcuaucuauugccugaugggauccggccagcuucugugggacaccguuacagggguggauauggcccucuga

SEQ ID NO: 212255 - RNA, 1401 nt, Artificial Sequence; identical to SEQ ID NO: 212186
  derived and/or modified sequence opt5 from neuraminidase__InfluenzaB__AGX17340

SEQ ID NO: 212256 - RNA, 1401 nt, Artificial Sequence
  derived and/or modified sequence opt5 from neuraminidase__InfluenzaB__AGX17351
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagaccaacggcgauaaggggucuggaggcaucaaaggcggguuuguucaucaacggauggcuuccaagauuggacgcugguacagcagaaccaugucuaaaacaaagcggaugggcauggggcuguaugugaaguacgacggagaccccugggcggauagcgacgcccuggcucucuccggcgucauggugucuauggaggaaccugggugguacagcuucggcuuugaaaucaaagauaagaaaugcgacgugccguguauuggaaucgagaugguccacgauggcgggaaggaaaccuggcauuccgccgccacagcuauuuauugccugaugggaagcggccagcuucugugggacacgguuaccgggguggauauggcccucuga

SEQ ID NO: 212257 - RNA, 1401 nt, Artificial Sequence
  derived and/or modified sequence opt5 from neuraminidase__InfluenzaB__AGX17362
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaauuccccucgauugcgccaacgcgucuaauauccaagcuguuaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucaucagagagcccuucauugccugcggcccuaaggaauguaaacauuuugcucucacacacuacgccgcgcagcccgggggauauuacaacggcacccggggcgaccgcaauaagcugagacaucugaucagcgugaagcucgggaaaauuccuacagucgagaacucuaucuuccacauggccgcuugguccggaagcgccugccaugauggcaaggaguggaccuauauugggguggacggacccgauaauaacgcucugcuuaaaaucaaguacggcgaagccuacacggacacauaucacucuuacgcgaauaacauucugcggacccaggaguccgccuguaauugcaucgggggaaacuguuaucucaugaucacagauggcagcgcuuccggcauuucugaaugccgcuuucugaaaaucagagaggggcggauuaucaaggagauuuucccgaccggacgcguuaagcacaccgaagaguguacaugcggcuuugccagcaauaaaacgaucgaaugugcuugcagagacaacuccuacaccgccaagcggccuuucgugaaacuuaaugucgagacagauaccgccgaaauccgccugaugugcacagagaccuaucucgacacgcccagaccugaugacgggagcauuacaggacccugugagucuaacggcgauaagggguccggaggcaucaaaggcggguuugugcaucaacggauggcuagcaagauuggacgcugguacucuagaaccaugagcaaaaccaagcggaugggcauggggcuguauguuaaguacgacggagaccccugggcggauuccgacgcccuggcucucucuggcgugauggucagcauggaggaaccugggugguacuccuucggcuuugaaaucaaagauaagaaaugcgacgugccguguauuggaaucgagauggugcacgauggcgggaaggaaacauggcauagcgccgccaccgcuaucuauugccugaugggaucuggccagcuucugugggacacagucacggggguugauauggcccucuga

SEQ ID NO: 212258 - RNA, 1401 nt, Artificial Sequence
  derived and/or modified sequence opt5 from neuraminidase__InfluenzaB__AGX17373
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccaauaacaaaacgauugaaugugcuugcagagacaauagcuacaccgccaagcggccuuucgugaaacuuaacguugagacagauaccgccgaaauccgccugaugugcacagagaccuaucucgacacgcccagaccugaugacggguccauuacaggacccugugagagcaacggcgauaaggggucuggaggcaucaaaggcggguuugugcaucaacggauggcuuccaagaucggacgcugguacagcagaaccaugucuaaaaccaagcggaugggcauggggcuguaugucaaguacgacggagaccccugggcggauagcgacgcccuggcucucuccggcgugauggugucuauggaggaaccugggugguacagcuucggcuuugaaauuaaagauaagaaaugcgacgucccguguaucggaauugagaugguucacgauggcgggaaggaaacauggcauuccgccgccaccgcuaucuauugccugaugggaagcggccagcuucugugggacacagugacgggggugaauauggcccucuga

SEQ ID NO: 212259 - RNA, 1401 nt, Artificial Sequence; identical to SEQ ID NO: 211638
  derived and/or modified sequence opt5 from neuraminidase__InfluenzaB__AGX17384

SEQ ID NO: 212260 - RNA, 1401 nt, Artificial Sequence; identical to SEQ ID NO: 211706
  derived and/or modified sequence opt5 from neuraminidase__InfluenzaB__AGX17395

SEQ ID NO: 212261 - RNA, 1401 nt, Artificial Sequence
  derived and/or modified sequence opt5 from neuraminidase__InfluenzaB__AGX17404
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggaucugauaauaacgcucugcuuaaaaucaaguacggcgaagccuacacggacacauaucacuccuacgcgaauaacauucugcggacccaggagagcgccuguaauugcaucgggggaaacuguuaucucaugauuacagauggcuccgcuucuggcaucagcgaaugccgcuuucugaaaaucagagaggggcggauuaucaaggagauuuuccccaccggacgcgugaagcacaccgaagaguguacaugcggcuuugccuccaauaaaacgaucgaaugugcuugcagagacaacagcuacaccgccaagcggccguucgucaaacuuaauguggagacagauaccgccgaaauucgccugaugugcacagagaccuaucucgacacgccuagacccgaugacgggucuaucacaggaccuugugaguccaacggcgauaaggggagcggaggcaucaaaggcggguuuguucaucaacggauggcuucuaagauuggacgcugguacagcagaaccauguccaaaaccaagcggaugggcauggggcuguaugugaaguacgacggagaccccugggcggauucugacgcccuggcucucagcggcaucauggucuccauggaggaacccgggugguacagcuucggcuuugaaauuaaagauaagaaaugcgacgugccuuguaucggaauugagauggugcacgauggcgggaaggaaacauggcauucugccgccaccgcuaucuauugccugaugggauccggccagcuucugugggacacagucacggggguugauauggcccucuga

SEQ ID NO: 212262 - RNA, 1401 nt, Artificial Sequence
  derived and/or modified sequence opt5 from neuraminidase__InfluenzaB__AGX17415
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgacuggaccuauccucggcucuccugucccggcagcacguuccagaaggcccugcuuauuucuccucaccgcuuuggggagaccaaaggaaauuccgcuccgcugaucauuagagaacccuucaucgccugcggcccuaaggaguguaaacauuuugcucucacacacuacgccgcgcagcccgggggauauuacaacggcacccggggcgaucgcaauaagcugagacaucugaucagcgucaagcucgggaaaauuccuacaguggaaaacucuaucuuccacauggccgcuugguccggaagcgccugccaugacggcaaggaguggaccuauauugggguugauggacccgacaauaacgcucugcuuaaaaucaaguacggcgaggccuacacggauacauaucacucuuacgcgaauaacauucugcggacccaggaauccgccuguaauugcaucgggggaaacuguuaucucaugauuacagacggcagcgcuuccggcaucucugagugccgcuuucugaaaaucagagaagggcggauuaucaaggagauuuucccgaccggacgcgugaagcacaccgaggaauguacaugcggcuuugccagcaauaaaacgaucgagugugcuugcagagauaacuccuacaccgccaagcggccuuucgucaaacuuaauguggaaacagacaccgccgagauucgccugaugugcacagaaaccuaucucgauacgcccagaccugacgaugggagcaucacaggacccugugagucuaacggcgacaagggguccggaggcaucaaaggcggguuuguucaucaacggauggcuagcaagauuggacgcugguacucuagaaccaugagcaaaaccaagcggaugggcauggggcuguaugugaaguacgacggagaucccugggcggacuccgaugcccuggcucucucuggcgucauggugagcauggaggaaccugggugguacuccuucggcuuugagaucaaagacaagaaaugcgaugugccguguauuggaaucgaaaugguccacgacggcgggaaggagacauggcauagcgccgccaccgcuauuuauugccugaugggaucuggccagcuucugugggauacaguuacggggguggacauggcccucuga

SEQ ID NO: 212263 - RNA, 1401 nt, Artificial Sequence
  derived and/or modified sequence opt5 from neuraminidase__InfluenzaB__AGX17426
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaaggaauguaaacauuucgcucugacacacuacgccgcgcagcccgggggauauuacaacggcacccggggcgaccgcaauaagcucagacaucugaucagcgucaagcuggggaaaauuccuacaguggagaacucuaucuuucacauggccgcuugguccggaagcgccugccaugauggcaaggaguggaccuauauugggguugacggacccgauaauaacgcucuccugaaaaucaaguacggcgaagccuacacggacacauaucacucuuacgcgaauaacauucuucggacccaggaguccgccuguaauugcaucgggggaaacuguuaucugaugauuacagauggcagcgcuuccggcaucucugaaugccgcuuccucaaaaucagagaggggcggauuaucaaggagauuuuuccgaccggacgcgugaagcacaccgaagaguguacaugcggcuucgccagcaauaaaacgaucgaaugugcuugcagagacaacuccuacaccgccaagcggccuuuugucaaacugaauguggagacagauaccgccgaaauucgccuuaugugcacagagaccuaucuggacacgcccagaccugaugacgggagcaucacaggacccugugagucuaacggcgauaagggguccggaggcaucaaaggcggguucguucaucaacggauggcuagcaagauuggacgcugguacucuagaaccaugagcaaaaccaagcggaugggcauggggcucuaugugaaguacgacggagaccccugggcggauuccgacgcccuggcucugucuggcgucauggugagcauggaggaaccugggugguacuccuuuggcuucgaaaucagagauaaaaagugcgacgugccguguauuggaaucgagaugguccacgauggcgggaaagaaacauggcauagcgccgccaccgcuauuuauugccucaugggaucuggccagcugcuuugggacacaguuacggggguggauauggcccuguga

SEQ ID NO: 212264 - RNA, 1401 nt, Artificial Sequence
  derived and/or modified sequence opt5 from neuraminidase__InfluenzaB__AGX17437
augcugcccagcaccauccagacacucacgcuguuccuuaccuccggcggggugcugcucucucuguacgucagcguuucccuuucuuaucugcucuacagcgacauucugcugaaguuuuccccuacagagaucaccgcccaaacaaugccgcucgauuucgcuaacgccucuaaugugcaggcggugaacagaagcgcuaccaaaggagucacacugcuucugcccgaaccugaguggaccuauccccggcucuccugcccuggcagcacguuucagaaggcccugcuuauuucuccccaccgcuucggggaaaccaaaggaaauuccgccccucugaucauuagagagccguuuaucgcuuguggccccaaggaaugcaaacauuucgcccucacacacuacgcugcccagccugggggauauuacaacggcacccggggcgaccgcaauaagcugagacaucugaucagcgugaagcucgggaaaauucccacaguugagaacucuaucuuucacauggcggccugguccggaagcgcuugucaugauggcaaggaguggaccuauauugggguggacggaccugauaauaacgcccugcuuaaaaucaaguacggcgaggcuuacacggacacauaucacucuuacgccaauaacauucugcggacccaagaguccgcgugcaauuguaucgggggaaacugcuaucucaugauuacagauggcagcgccuccggcaucucugaaugucgcuuccugaaaaucagagaggggcggauuaucaaggagauuuuucccaccggacgcgucaagcacaccgaagagugcacauguggcuucgcuagcaauaaaacgaucgaaugcgccuguagagacaacuccuacaccgcuaagcggccguuugugaaacuuaauguugagacagauaccgccgaaauucgccugaugugcacagagaccuaucucgacacgccuagacccgaugacgggagcaucacaggaccuugcgagucuaacggcgauaagggguccggaggcaucaaaggcggguucgugcaucagcggauggccagcaagauuggacgcugguacucuagaaccaugagcaaaaccaagcggaugggcauggggcuguaugucaaguacgacggagaccccugggcugauuccgacgcgcuggcccucucuggcgugauggugagcauggaagaacccgggugguacuccuuuggcuucgaaaucagagauaaaaagugugacgucccuugcauuggaaucgagaugguucacgauggcgggaaagaaacauggcauagcgcugccaccgccauuuauugucugaugggaucuggccagcuucugugggacacagugacggggguggauauggcucucuga

SEQ ID NO: 212265 - RNA, 1401 nt, Artificial Sequence
  derived and/or modified sequence opt5 from neuraminidase__InfluenzaB__AGX17448
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagaccaacggcgauaaggggucuggaggcaucaaaggcggguuuguucaucaacggauggcuuccaagauuggacgcugguacagcagaaccaugucuaaaacaaagcggaugggcauggggcuguaugugaaguacgacggagaccccugggcggauagcgacgcccugguccucuccggcgugauggugucuauggaggaaccugggugguacagcuucggcuuugaaaucaaagauaagaaaugcgacgucccguguauuggaaucgagaugguucacgauggcgggaaggaaaccuggcauuccgcugccacagccauuuauugccugaugggaagcggccagcuucugugggacacggugaccgggguggauauggcucucuga

SEQ ID NO: 212266 - RNA, 1401 nt, Artificial Sequence
  derived and/or modified sequence opt5 from neuraminidase__InfluenzaB__AGX17459
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuucuacaaugccgcucgauugcgccaacgcgagcaauguucaagcugugaacagauccgccaccaaaggagugacacugcuucugcccgaaccugacuggaccuauccccggcucagcuguccuggcucuacguuccagaaggcccugcuuauuagcccccaccgcuuuggggagaccaaaggaaauuccgcuccucugaucauuagagaaccguucaucgccugcggccccaaggaguguaaacauuuugcucucacacacuacgccgcgcagccugggggauauuacaacggcacccggggcgaucgcaauaagcugagacaucugaucucugucaagcucgggaaaauucccacaguggaaaacuccaucuuccacauggccgcuuggagcggaucugccugccaugacggcaaggaguggaccuauauugggguugauggaccugacaauaacgcucugcuuaaaaucaaguacggcgaggccuacacggauacauaucacuccuacgcgaauaacauucugcggacccaggaaagcgccuguaauugcaucgggggaaacuguuaucucaugauuacagacggcuccgcuucuggcaucagcgagugccgcuuucugaaaaucagagaagggcggauuaucaaggagauuuuccccaccggacgcgugaagcacaccgaggaauguacaugcggcuuugccuccaauaaaacgaucgagugugcuugcagagauaacagcuacaccgccaagcggccguucgucaaacuuaauguggaaacagacaccgccgagauucgccugaugugcacagaaaccuaucucgauacgccuagacccgacgaugggucuaucacaggaccuugugaguccaacggcgacaaggggagcggaggcaucaaaggcggguuuguucaucaacggauggcuucuaagauuggacgcugguacagcagaaccauguccaaaaccaagcggaugggcauggggcuguaugugaaguacgacggagaucccugggcggacucugaugcccuggcucucagcggcgucaugguguccauggaggaacccgggugguacagcuucggcuuugagaucaaagacaagaaaugcgaugugccuuguauuggaaucgaaaugguccacgacggcgggaaggagacauggcauucugccgccaccgcuauuuauugccugaugggauccggccagcuucugugggauacaguuacggggguggacauggcccucuga

SEQ ID NO: 212267 - RNA, 1401 nt, Artificial Sequence; identical to SEQ ID NO: 211638
  derived and/or modified sequence opt5 from neuraminidase__InfluenzaB__AGX17470

SEQ ID NO: 212268 - RNA, 1401 nt, Artificial Sequence
  derived and/or modified sequence opt5 from neuraminidase__InfluenzaB__AGX17481
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugauucuuccugaacccgaguggaccuauccucggcuguccugucccggcagcacguuccagaaggcccuccugaucucuccucaccgcuuuggggaaaccaaaggaaauuccgcuccgcuuauuaucagagagcccuucaucgccugcggcccuaaggaauguaaacauuuugcucugacacacuacgccgcgcagcccgggggauauuacaacggcacccggggcgaccgcaauaagcucagacaucugauuagcgucaagcuggggaaaaucccuacaguggagaacucuauuuuccacauggccgcuugguccggaagcgccugccaugauggcaaggaguggaccuauaucgggguugacggacccgauaauaacgcucuccugaaaauuaaguacggcgaagccuacacggacacauaucacucuuacgcgaauaacauccuucggacccaggaguccgccuguaauugcauugggggaaacuguuaucugaugaucacagauggcagcgcuuccggcaucucugaaugccgcuuucucaaaauuagagaggggcggaucauuaaggagaucuucccgaccggacgcgugaagcacaccgaagaguguacaugcggcuuugccagcaauaaaacgauugaaugugcuugcagagacaacuccuacaccgccaagcggccuuucgucaaacugaauguggagacagauaccgccgaaauccgccuuaugugcacagagaccuaucuggacacgcccagaccugaugacgggagcaucacaggacccugugagucuaacggcgauaagggguccggaggcauuaaaggcggguuuguucaucaacggauggcuagcaagaucggacgcugguacucuagaaccaugagcaaaaccaagcggaugggcauggggcucuaugugaaguacgacggagaccccugggcggauuccgacgcccuggcucugucuggcgucauggugagcguggaggaaccugggugguacuccuucggcuuugaaauuaaagauaagaaaugcgacgucccguguaucggaauugagaugguucacgauggcgggaaggaaacauggcauagcgccgccaccgcuaucuauugccucaugggaucuggccagcugcuuugggacacagugacggggguggauauggcccuguga

SEQ ID NO: 212269 - RNA, 1401 nt, Artificial Sequence
  derived and/or modified sequence opt5 from neuraminidase__InfluenzaB__AGX17492
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccugggcggauuccgacgcccuggcucucucuggcgucauggugagcauggaggaaccugggugguacuccuucggcuuugaaaucaaagauaagaaaugcgacgugccguguauuggaaucgagaugguccacgauggcgggaaggaaacauggcauagcgccgccaccgcuauuuauugccugaugggaucuggccagcuucugugggacacaguuacggggguggauaucgcccucuga

SEQ ID NO: 212270 - RNA, 1401 nt, Artificial Sequence
  derived and/or modified sequence opt5 from neuraminidase__InfluenzaB__AGX17503
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggccugacguuccagaaggcccuucugauuagcccucaccgcuuuggggaaaccaaaggaaauucugcuccgcucaucauuagagagcccuucaucgccugcggcccuaaggaauguaaacauuuugcucugacacacuacgccgcgcagcccgggggauauuacaacggcacccggggcgaccgcaauaagcugagacaucucaucuccgucaagcuggggaaaauuccuacaguggagaacagcaucuuccacauggccgcuuggucuggauccgccugccaugauggcaaggaguggaccuauauugggguugacggacccgauaauaacgcucugcuuaaaaucaaguacggcgaagccuacacggacacauaucacagcuacgcgaauaacauucuccggacccaggagucugccuguaauugcaucgggggaaacuguuaucugaugauuacagauggcuccgcuagcggcaucuccgaaugccgcuuucuuaaaaucagagaggggcggauuaucaaggagauuuucccgaccggacgcgugaagcacaccgaagaguguacaugcggcuuugccucuaauaaaacgaucgaaugugcuugcagagacaacagcuacaccgccaagcggccuuucgucaaacugaauguggagacagauaccgccgaaauucgccucaugugcacagagaccuaucuggacacgcccagaccugaugacggguccaucacaggacccugugagagcaacggcgauaaggggucuggaggcaucaaaggcggguuuguucaucaacggauggcuuccaagauuggacgcugguacagcagaaccaugucuaaaaccaagcggaugggcauggggcuguaugugaaguacgacggagaccccugggcggauagcgacgcccucgcucuguccggcgucauggugucuauggaggaaccugggugguacagcuucggcuuugaaaucaaagauaagaaaugcgacgugccguguauuggaaucgagaugguccacgauggcgggaaggaaacauggcauuccgccgccaccgcuauuuauugccuuaugggaagcggccagcugcucugggacacaguuacggggguggauauggcccuguga

SEQ ID NO: 212271 - RNA, 1401 nt, Artificial Sequence; identical to SEQ ID NO: 211638
  derived and/or modified sequence opt5 from neuraminidase__InfluenzaB__AGX17514

SEQ ID NO: 212272 - RNA, 1401 nt, Artificial Sequence
  derived and/or modified sequence opt5 from neuraminidase__InfluenzaB__AGX17525
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcaagcggggcgaccgcaauaagcugagacaucugaucagcgucaaacucgggaagauuccuaccguggagaacucuaucuuccacauggccgcuugguccggaagcgccugccaugauggcaaagaguggacauauauugggguugacggacccgauaauaacgcucugcuuaagaucaaauacggcgaagccuacaccgacacguaucacucuuacgcgaauaacauucugcggacacaggaguccgccuguaauugcaucgggggaaacuguuaucucaugauuaccgauggcagcgcuuccggcaucucugaaugccgcuuucugaagaucagagaggggcggauuaucaaggagauuuucccgacaggacgcgugaaacacaccgaagaguguaccugcggcuuugccagcaauaagacaaucgaaugugcuugcagagacaacuccuacacggccaaacggccuuucgucaaacuuaauguggagaccgauacagccgaaauucgccugaugugcaccgagacauaucucgacacccccagaccugaugacgggagcaucacgggacccugugagucuaacggcgauaagggguccggaggcaucaagggcggguuuguucaucaacggauggcuagcaaaauuggacgcugguacucuagaacaaugagcaagaccaagcggaugggcauggggcuguaugugaaauacgacggagaccccugggcggauuccgacgcccuggcucucucuggcgucauggugagcauggaggaaccugggugguacuccuucggcuuugaaaucagagauaagaaaugcgacgugccguguauuggaaucgagaugguccacgauggcgggaaggaaaccuggcauagcgccgccacagcuauuuauugccugaugggaucuggccagcuucugugggacaccguuacagggguggauauggcccucuga

SEQ ID NO: 212273 - RNA, 1401 nt, Artificial Sequence; identical to SEQ ID NO: 212217
  derived and/or modified sequence opt5 from neuraminidase__InfluenzaB__AGX17536

SEQ ID NO: 212274 - RNA, 1401 nt, Artificial Sequence; identical to SEQ ID NO: 212248
  derived and/or modified sequence opt5 from neuraminidase__InfluenzaB__AGX17547

SEQ ID NO: 212275 - RNA, 1401 nt, Artificial Sequence
  derived and/or modified sequence opt5 from neuraminidase__InfluenzaB__AGX17558
augcugcccagcaccauccagacacucacgcuguuccuuaccuccggcggggugcugcucucucuguacgucagcgccucccuuucuuaucugcucuacagcgacguucugcugaaguuuuccccugcugagauuacagccccgaccaugccccucgauugcgcgaacgcuucuaaugugcaagccgugaacagaagcgccacaaaaggagucacccugcuucugccugaacccgaguggacauauccucggcucuccugucccggcagcaccuuccagaaggcucugcuuaucucuccucaccgcuuuggggaaacgaaaggaaauuccgccccgcugauuaucagagagcccuucauugcuugcggcccuaaggaauguaaacauuuugcccucacccacuacgcggcccagcccgggggauauuacaacggcacacggggcgaccgcaauaagcugagacaucugaucagcgugaagcucgggaaaaucccuaccguugagaacucuauuuuccacauggcugccugguccggaagcgcuugccaugauggcaaggaguggacauauaucgggguggacggacccgauaauaacgcccugcuuaaaauuaaguacggcgaagcguacaccgacacguaucacucuuacgccaauaacauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcgugaagcacaccgaagaguguaccugcggcuuugcuagcaauaaaacaaucgaaugugccugcagagacaacuccuacacggccaagcggccuuucguuaaacuuaauguggagaccgauacagcugaaauucgccugaugugcaccgagacauaucucgacacccccagaccugaugacgggagcaucacgggacccugugagucuaacggcgauaagggguccggaggcauuaaaggcggguuuguccaucaacggauggcgagcaagaucggacgcugguacucuagaacaaugagcaaaaccaagcggaugggcauggggcuguaugugaaguacgacggagaccccugggccgauuccgacgcucuggcccucucuggcgugauggucagcauggaggaaccugggugguacuccuucggcuuugaaaucaaagauaagaaaugcgacguuccguguauuggaaucgagauggugcacgauggcgggaaggaaaccuggcauagcgccgcuacagccauuuauugccugaugggaucuggccagcuucugugggacaccgugacaggggucgauauggcgcucuga

SEQ ID NO: 212276 - RNA, 1401 nt, Artificial Sequence; identical to SEQ ID NO: 211767
  derived and/or modified sequence opt5 from neuraminidase__InfluenzaB__AGX17569

SEQ ID NO: 212277 - RNA, 1401 nt, Artificial Sequence; identical to SEQ ID NO: 211694
  derived and/or modified sequence opt5 from neuraminidase__InfluenzaB__AGX17580

SEQ ID NO: 212278 - RNA, 1401 nt, Artificial Sequence
  derived and/or modified sequence opt5 from neuraminidase__InfluenzaB__AGX17591
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccgucaagcucgggaaaauucccacaguggagaacagcaucuuccacauggccgcuuggucuggauccgccugccaugauggcaaggaguggaccuauauugggguugacggaccggauaauaacgcucugcuuaaaaucaaguacggcgaagccuacacggacacauaucacagcuacgcgaauaacauucugcggacccaggagucugccuguaauugcaucgggggaaacuguuaucucaugauuacagauggcuccgcuagcggcguguccgaaugccgcuuucugaaaaucagagaggggcggaucauuaaggagaucuucccuaccggacgcgucaagcacaccgaagaguguacaugcggcuuugccucuaauaaaacgauugaaugugcuugcagagacaacagcuacaccgccaagcggcccuucgugaaacuuaauguugagacagauaccgccgaaauccgccugaugugcacagagaccuaucucgacacgccuagacccgaugacggguccauuacaggacccugugagagcaacggcgauaaggggucuggaggcaucaaaggcggguuugugcaucaacggauggcuuccaagaucggacgcugguacagcagaaccaugucuaaaaccaagcggaugggcauggggcuguaugucaaguacgacggagacccuugggcggauagcgacgcccuggcuuucuccggcgugauggugucuauggaggaaccggggugguacagcuuuggcuucgaaauuaaagauaagaaaugcgacguccccuguaucggaauugagaugguucacgauggcgggaaggaaacauggcauuccgccgccaccgcuaucuauugccucaugggaagcggccagcugcuuugggacacagugacgggggugaacauggcccuguga

SEQ ID NO: 212279 - RNA, 1401 nt, Artificial Sequence; identical to SEQ ID NO: 211692
  derived and/or modified sequence opt5 from neuraminidase__InfluenzaB__AGX17602

SEQ ID NO: 212280 - RNA, 1401 nt, Artificial Sequence; identical to SEQ ID NO: 212278
  derived and/or modified sequence opt5 from neuraminidase__InfluenzaB__AGX17613

SEQ ID NO: 212281 - RNA, 1401 nt, Artificial Sequence; identical to SEQ ID NO: 211865
  derived and/or modified sequence opt5 from neuraminidase__InfluenzaB__AGX17624

SEQ ID NO: 212282 - RNA, 1401 nt, Artificial Sequence
  derived and/or modified sequence opt5 from neuraminidase__InfluenzaB__AGX17635
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccgucaagcucgggaaaauucccacaguggagaacagcaucuuccacauggccgcuuggucuggauccgccugccaugauggcaaggaguggaccuauauugggguugacggaccggauaauaacgcucugcuuaaaaucaaguacggcgaagccuacacggacacauaucacagcuacgcgaauaacauucugcggacccaggagucugccuguaauugcaucgggggaaacuguuaucucaugauuacagauggcuccgcuagcggcaucuccgaaugccgcuuucugaaaaucagagaggggcggauuaucaaggagauuuucccuaccggacgcgugaagcacaccgaagaguguacaugcggcuuugccucuaauaaaacgaucgaaugugcuugcagagacaacagcuacaccgccaagcggcccuucgucaaacuuaauguggagacagauaccgccgaaauucgccugaugugcacagagaccuaucucgacacgccuagacccgaugacggguccaucacaggacccugugagagcaacggcgauaaggggucuggaggcaucaaaggcggguuuguucaucaacggauggcuuccaagauuggacgcugguacagcagaaccaugucuaaaaccaagcggaugggcauggggcuguaugugaaguacgacggagacccuugggcggauagcgacgcccuggcuuucuccggcgucauggugucuauggaggaaccggggugguacagcuuuggcuucgaaaucaaagauaagaaaugcgacgugcccuguauuggaaucgagaugguccacgauggcgggaaggaaacauggcauuccgccgccaccgcuauuuauugccucaugggaagcggccagcugcuuugggacacaguuacgggggugaacauggcccuguga

SEQ ID NO: 212283 - RNA, 1401 nt, Artificial Sequence; identical to SEQ ID NO: 211865
  derived and/or modified sequence opt5 from neuraminidase__InfluenzaB__AGX17657

SEQ ID NO: 212284 - RNA, 1401 nt, Artificial Sequence; identical to SEQ ID NO: 212278
  derived and/or modified sequence opt5 from neuraminidase__InfluenzaB__AGX17668

SEQ ID NO: 212285 - RNA, 1401 nt, Artificial Sequence
  derived and/or modified sequence opt5 from neuraminidase__InfluenzaB__AGX17679
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagaucgauacagccgaaauucgccugaugugcaccgacacauaucucgauacccccagaccugacgaugggagcaucacgggacccugugagucuaacggcgacaagggguccggaggcaucaagggcggguuugugcaucaacggauggcuagcaaaauuggacgcugguacucuagaacaaugagcaagaccgagcggaugggcauggggcuguaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucacgacggcgggaaagagaccuggcauagcgccgccacagcuauuuauugccucaugggaucuggccagcugcuuugggauaccgugacagggguggacauggcccuguga

SEQ ID NO: 212286 - RNA, 1401 nt, Artificial Sequence; identical to SEQ ID NO: 211865
  derived and/or modified sequence opt5 from neuraminidase__InfluenzaB__AGX17690

SEQ ID NO: 212287 - RNA, 1401 nt, Artificial Sequence
  derived and/or modified sequence opt5 from neuraminidase__InfluenzaB__AGX17701
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcaagcggggcgaccgcaauaagcugagacaucugaucuccgucaaacucgggaagauucccaccguggagaacagcaucuuccacauggccgcuuggucuggauccgccugccaugauggcaaagaguggacauauauugggguugacggaccggauaauaacgcucugcuuaagaucaaauacggcgaagccuacaccgacacguaucacagcuacgcgaauaacauucugcggacacaggagucugccuguaauugcaucgggggaaacuguuaucucaugauuaccgauggcuccgcuagcggcguguccgaaugccgcuuucugaagaucagagaggggcggaucauuaaggagaucuucccuacaggacgcgucaaacacaccgaagaguguaccugcggcuuugccucuaauaagacaauugaaugugcuugcagagacaacagcuacacggccaaacggcccuucgugaaacuuaauguugagaccgauacagccgaaauccgccugaugugcaccgagacauaucucgacaccccuagacccgaugacggguccauuacgggacccugugagagcaacggcgauaaggggucuggaggcaucaagggcggguuugugcaucaacggauggcuuccaaaaucggacgcugguacagcagaacaaugucuaagaccaagcggaugggcauggggcuguaugucaaauacgacggagacccuugggcggauagcgacgcccuggcuuucuccggcgugauggugucuauggaggaaccggggugguacagcuuuggcuucgaaauuaaggauaaaaagugcgacguccccuguaucggaauugagaugguucacgauggcgggaaagaaaccuggcauuccgccgccacagcuaucuauugccucaugggaagcggccagcugcuuugggacaccgugacaggggugaacauggcccuguga

SEQ ID NO: 212288 - RNA, 1401 nt, Artificial Sequence; identical to SEQ ID NO: 211865
  derived and/or modified sequence opt5 from neuraminidase__InfluenzaB__AGX17723

SEQ ID NO: 212289 - RNA, 1401 nt, Artificial Sequence; identical to SEQ ID NO: 212285
  derived and/or modified sequence opt5 from neuraminidase__InfluenzaB__AGX17734

SEQ ID NO: 212290 - RNA, 1401 nt, Artificial Sequence
  derived and/or modified sequence opt5 from neuraminidase__InfluenzaB__AGX17745
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguuccggcagcacguuccagaaggcccugcuuauuucuccucaccgcuuuggggaaaucaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacauccugcggacacaggaguccgccuguaauugcauugggggaaacuguuaucucaugaucaccgauggcagcgcuuccggcgugucugaaugccgcuuucugaaaaucagagaggggcggauuaucaaggagauuuucccgacaggacgcgucaagcacaccgaagaguguaccugcggcuuugccagcaauaaaacaaucgaaugugcuugcagagacaacuccuacacggccaagcggccuuucgugaaacuuaauguugagaccgauacagccgaaauucgccugaugugcaccgagacauaucucgacacccccagaccugaugacgggagcaucacgggacccugugagucuaacggcgauaagggguccggaggcaucaaaggcggguuugugcaucaacggauggcuagcaagauuggacgcugguacucuagaacaaugagcaaaaccaagcggaugggcauggggcuguaugucaaguacgacggagaccccugggcggauuccgacgcccuggcuuucucuggcgugauggugagcauggaggaaccugggugguacuccuuuggcuucgaaaucaaagauaagaaaugcgacgucccguguauuggaaucgagaugguucacgauggcgggaaggaaaccuggcauagcgccgccacagcuauuuauugccucaugggaucuggccagcugcuuugggacaccgugacaggggugaacauggcccuguga

SEQ ID NO: 212291 - RNA, 1401 nt, Artificial Sequence
  derived and/or modified sequence opt5 from neuraminidase__InfluenzaB__AGX17756
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcggcccgggggauauuacaauggcacccgcggcgacagaaacaaacugcggcaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcgcacccaggaguccgccuguaacugcaucgggggaaauuguuaucucaugauuacagauggcagcgcuuccggcgugucugaaugcagauuucugaagauccgggaggggcgcaucauuaaagagaucuucccgaccggaagagucaagcauaccgaagaguguacaugcggcuuugccagcaacaagacgauugaaugugcuugccgggacaauuccuacaccgccaaacgcccuuucgugaaacuuaacguugagacagauaccgccgaaaucagacugaugugcacagacaccuaucucgauacgccccggccugacgaugggagcauuacaggacccugugagucuaacggcgacaagggguccggaggcaucaagggcggguuugugcaccagcgcauggcuagcaaaaucggaagaugguacucucggaccaugagcaagaccgagagaaugggcauggggcuguaugucaaauacgacggagaucccugggcggacuccgaugcccuggcuuucucuggcgugauggugagcaugaaggaaccugggugguacuccuuuggcuucgagauuaaggacaaaaagugcgaugucccguguaucggaauugaaaugguucaugacggcgggaaagagacauggcacagcgccgccaccgcuaucuauugccucaugggaucuggccagcugcuuugggauacagugacggggguggacauggcccuguga

SEQ ID NO: 212292 - RNA, 1401 nt, Artificial Sequence; identical to SEQ ID NO: 211912
  derived and/or modified sequence opt5 from neuraminidase__InfluenzaB__AGX17767

SEQ ID NO: 212293 - RNA, 1401 nt, Artificial Sequence
  derived and/or modified sequence opt5 from neuraminidase__InfluenzaB__AGX17778
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaccagcggauggcuagcaaaaucggacgcugguacucuagaaccaugagcaagaccgagcggaugggcauggggcuguaugucaaauacgacggagaucccugggcggaauccgacgcccuggcuuucucuggcgugauggugagcaugaaggagccugggugguacuccuuuggcuucgaaauuaaggauaaaaagugcgacgucccguguaucggaauugagaugguucaugauggcgggaaagaaacauggcacagcgccgccaccgcuaucuauugccucaugggaucuggccaacugcuuugggacacagugacggggguggauauggcccuguga

SEQ ID NO: 212294 - RNA, 1401 nt, Artificial Sequence
  derived and/or modified sequence opt5 from neuraminidase__InfluenzaB__AGX17789
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagaucgauacagccgaaauucgccugaugugcaccgacacauaucucgauacccccagaccugacgaugggagcaucacgggacccugugagucuaacggcgacaagggguccggaggcaucaagggcggguuugugcaucaacggauggcuagcaaaauuggacgcugguacucuagaacaaugagcaagaccgagcggaugggcauggggcuguaugucaaauacgacggagaucccugggcggacuccgaugcccugguguucucuggcgugauggucagcaugaaggaaccugggugguacuccuuuggcuucgagaucaaggacaaaaagugcgauguuccguguauuggaaucgaaauggugcacgacggcgggaaagagaccuggcauagcgcugccacagccauuuauugccucaugggaucuggccagcugcuuugggauaccgugacaggggucgacauggcucuguga

SEQ ID NO: 212295 - RNA, 1401 nt, Artificial Sequence; identical to SEQ ID NO: 211865
  derived and/or modified sequence opt5 from neuraminidase__InfluenzaB__AGX17800

SEQ ID NO: 212296 - RNA, 1401 nt, Artificial Sequence
  derived and/or modified sequence opt5 from neuraminidase__InfluenzaB__AGX17811
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccgucaagcucgggaaaauucccacaguggagaacagcaucuuccacauggccgcuuggucuggauccgccugccaugauggcaaggaguggaccuauauugggguugacggaccggauaauaacgcucugcuuaaaaucaaguacggcgaagccuacacggacacauaucacagcuacgcgaauaacauucugcggacccaggagucugccuguaauugcaucgggggaaacuguuaucucaugauuacagauggcuccgcuagcggcguguccgaaugccgcuuucugaaaaucagagaggggcggaucauuaaggagaucuucccuaccggacgcgucaagcacaccgaagaguguacaugcggcuuugccucuaauaaaacgauugaaugugcuugcagagacaacagcuacaccgccaagcggcccuucgugaaacuuaauguugagacagauaccgccgaaauccgccugaugugcacagagaccuaucucgacacgccuagacccgaugacggguccauuacaggacccugugagagcaacggcgauaaggggucuggaggcaucaaaggcggguuugugcaucaacggauggcuuccaagaucggacgcugguacagcagaaccaugucuaaaaccaagcggaugggcauggggcuguaugucaaguacgacggagacccuugggcggauagcgacgcccuggcuuucuccggcgugauggugucuauggaggaaccggggugguacagcuuuggcuucgaaauuaaagauaagaaaugcgacguccccuguaucggaauugagaugguucacgauggcgggaaggaaacauggcauuccgccgccaccgcuaucuauugccucaugggaagcggccagcugcuuugggacacagugacgggggugaacauggcccaguga

SEQ ID NO: 212297 - RNA, 1401 nt, Artificial Sequence; identical to SEQ ID NO: 212278
  derived and/or modified sequence opt5 from neuraminidase__InfluenzaB__AGX17822

SEQ ID NO: 212298 - RNA, 1401 nt, Artificial Sequence
  derived and/or modified sequence opt5 from neuraminidase__InfluenzaB__AGX17833
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccauuaagcucgggaaaauccccacagucgagaacagcauuuuccacauggccgcuuggucuggauccgccugccaugauggcaaggaguggaccuauaucgggguggacggaccggauaauaacgcucugcuuaaaauuaaguacggcgaagccuacacggacacauaucacagcuacgcgaauaacauccugcggacccaggagucugccuguaauugcauugggggaaacuguuaucucaugaucacagauggcuccgcuagcggcguuuccgaaugccgcuuucugaaaaucagagaggggcggauuaucaaggagauuuucccuaccggacgcgugaagcacaccgaagaguguacaugcggcuuugccucuaauaaaacgaucgaaugugcuugcagagacaacagcuacaccgccaagcggcccuucgucaaacuuaauguggagacagauaccgccgaaauucgccugaugugcacagagaccuaucucgacacgccuagacccgaugacggguccaucacaggacccugugagagcaacggcgauaaggggucuggaggcaucaaaggcggguuuguucaucaacggauggcuuccaagauuggacgcugguacagcagaaccaugucuaaaaccaagcggaugggcauggggcuguaugugaaguacgacggagacccuugggcggauagcgacgcccuggcuuucuccggcgucauggugucuauggaggaaccggggugguacagcuuuggcuucgaaaucaaagauaagaaaugcgacgugcccuguauuggaaucgagaugguccacgauggcgggaaggaaacauggcauuccgccgccaccgcuauuuauugccucaugggaagcggccagcugcuuugggacacaguuacgggggugaacauggcccuguga

SEQ ID NO: 212299 - RNA, 1401 nt, Artificial Sequence; identical to SEQ ID NO: 212285
  derived and/or modified sequence opt5 from neuraminidase__InfluenzaB__AGX17844

SEQ ID NO: 212300 - RNA, 1401 nt, Artificial Sequence; identical to SEQ ID NO: 212293
  derived and/or modified sequence opt5 from neuraminidase__InfluenzaB__AGX17855

SEQ ID NO: 212301 - RNA, 1401 nt, Artificial Sequence; identical to SEQ ID NO: 211912
  derived and/or modified sequence opt5 from neuraminidase__InfluenzaB__AGX17866

SEQ ID NO: 212302 - RNA, 1401 nt, Artificial Sequence; identical to SEQ ID NO: 212278
  derived and/or modified sequence opt5 from neuraminidase__InfluenzaB__AGX17877

SEQ ID NO: 212303 - RNA, 1401 nt, Artificial Sequence; identical to SEQ ID NO: 212285
  derived and/or modified sequence opt5 from neuraminidase__InfluenzaB__AGX17888

SEQ ID NO: 212304 - RNA, 1401 nt, Artificial Sequence; identical to SEQ ID NO: 212278
  derived and/or modified sequence opt5 from neuraminidase__InfluenzaB__AGX17899

SEQ ID NO: 212305 - RNA, 1401 nt, Artificial Sequence; identical to SEQ ID NO: 212285
  derived and/or modified sequence opt5 from neuraminidase__InfluenzaB__AGX17910

SEQ ID NO: 212306 - RNA, 1401 nt, Artificial Sequence; identical to SEQ ID NO: 212285
  derived and/or modified sequence opt5 from neuraminidase__InfluenzaB__AGX17921

SEQ ID NO: 212307 - RNA, 1401 nt, Artificial Sequence; identical to SEQ ID NO: 211912
  derived and/or modified sequence opt5 from neuraminidase__InfluenzaB__AGX17932

SEQ ID NO: 212308 - RNA, 1401 nt, Artificial Sequence
  derived and/or modified sequence opt5 from neuraminidase__InfluenzaB__AGX17943
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccguccggcucgggaagauucccacaguggagaacagcaucuuccacauggccgcuuggucuggauccgccugccaugauggcaaagaguggaccuauauugggguugacggaccggauaauaacgcucugcuuaagaucaaauacggcgaagccuacacggacacauaucacagcuacgcgaauaacauucugcgcacccaggagucugccuguaauugcaucgggggaaacuguuaucucaugauuacagauggcuccgcuagcggcguguccgaaugcagauuucugaagauccgggaggggcgcaucauuaaagagaucuucccuaccggaagagucaagcacaccgaagaguguacaugcggcuuugccucuaauaagacgauugaaugugcuugccgggacaacagcuacaccgccaaacgccccuucgugaaacuuaauguugagacagauaccgccgaaaucagacugaugugcacagagaccuaucucgacacgccucggcccgaugacggguccauuacaggacccugugagagcaacggcgauaaggggucuggaggcaucaagggcggguuugugcaucaacgcauggcuuccaaaaucggaagaugguacagccggaccaugucuaagaccaaaagaaugggcauggggcuguaugucaaguacgacggagacccuugggcggauagcgacgcccuggcuuucuccggcgugauggugucuauggaggaaccggggugguacagcuuuggcuucgaaauuaaggauaaaaagugcgacguccccuguaucggaauugagaugguucacgauggcgggaaagaaacauggcauuccgccgccaccgcuaucuauugccucaugggaagcggccagcugcuuugggacacagugacgggggugaacauggcccuguga

SEQ ID NO: 212309 - RNA, 1401 nt, Artificial Sequence; identical to SEQ ID NO: 212278
  derived and/or modified sequence opt5 from neuraminidase__InfluenzaB__AGX17954

SEQ ID NO: 212310 - RNA, 1401 nt, Artificial Sequence
  derived and/or modified sequence opt5 from neuraminidase__InfluenzaB__AGX17976
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacaccucugcuucccgaaccugaguggaccuauccccggcuguccuguccuggcagcacguuccaaaaggcccuccugauuucuccgcaucgcuuuggggaaaccaaaggaaauuccgcuccccuuaucauuagagagccuuucaucgccugcggccccaacgaauguaagcacuuugcucugacacauuacgccgcgcagccugggggauauuacaauggcacccggggcgaccgcaacaaacucagacaccugaucagcgucaagcuggggaagauucccacaguggaaaauucuaucuuccauauggccgcuugguccggaagcgccugccacgauggcaaagaguggaccuauauugggguugacggaccggauaacaaugcucuccugaagaucaaauacggcgaggccuacacggacacauaucacucuuacgcgaacaauauucuucggacccaggaguccgccuguaacugcaucgggggaaauuguuaucugaugauuacagauggcagcgcuuccggcgugucugaaugccgcuuucucaagaucagagaggggcggaucauuaaagagaucuucccuaccggacgcgucaagcauaccgaagaguguacaugcggcuuugccagcaacaagacgauugaaugugcuugcagagacaauuccuacaccgccaaacggcccuucgugaagcugaacguugagacagauaccgccgaaauccgccuuaugugcacagacaccuaucuggauacgccuagacccgacgaugggagcauuacaggacccugugagucuaacggcgacaaaggguccggaggcaucaagggcggguuugugcaccagcggauggcuagcaaaaucggacgcugguacucuagaaccaugagcaagaccgagcggaugggcauggggcucuaugucaaauacgacggagauccuugggcggacuccgaugcccuggcuuucucuggcgugauggugagcaugaaggaaccggggugguacuccuuuggcuucgagauuaaggacaaaaagugcgauguccccuguaucggaauugaaaugguucaugacggcgggaaagagacauggcacagcgccgccaccgcuaucuauugccugaugggaucuggccaacuccugugggauacagugacggggguggacauggcccuuuga

SEQ ID NO: 212311 - RNA, 1401 nt, Artificial Sequence
  derived and/or modified sequence opt5 from neuraminidase__InfluenzaB__AGX17987
augcugcccagcaccauccagacacucacgcuguuccuuaccuccggcggggugcugcucucucuguacgucagcguuucccuuucuuaucugcucuacagcgacauucugcugaaguuuccuccgacagagaucaccgcccccacaaugccucucgauugcgcuaacgccuccaaugugcaagcggugaacagaucugcuaccaaaggagucacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgcuugcggccccaaggaauguaaacauuuugcccucacacacuacgcugcccagccugggggauauuacaacggcacccggggcgaccgcaauaagcugagacaucugaucuccgugaagcucgggaaaauucccacaguugagaacagcaucuuccacauggcggccuggucuggauccgcuugccaugauggcaaggaguggaccuauauugggguggacggaccggauaauaacgcccugcuuaaaaucaaguacggcgaagccuacacggacacauaucacagcuacgccaauaacauucugcggacccaggagucugcguguaauugcaucgggggaaacuguuaucucaugauuacagauggcuccgccagcggcgucuccgaaugccgcuuucugaaaaucagagaggggcggaucauuaaggagaucuucccuaccggacgcgugaagcacaccgaagaguguacaugcggcuuugcuucuaauaaaacgauugaaugugccugcagagacaacagcuacaccgcuaagcggcccuucguuaaacuuaauguggagacagauaccgccgaaauccgccugaugugcacagagaccuaucucgacacgccuagacccgaugacggguccauuacaggacccugugagagcaacggcgauaaggggucuggaggcaucaaaggcggguuuguccaucaacggauggccuccaagaucggacgcugguacagcagaaccaugucuaaaaccaagcggaugggcauggggcuguaugugaaguacgacggagacccuugggcugauagcgacgcgcuggccuucuccggcgugauggucucuauggaggaaccggggugguacagcuuuggcuucgaaauuaaagauaagaaaugcgacguucccuguaucggaauugagauggugcacgauggcgggaaggaaacauggcauuccgcugccaccgccaucuauugccucaugggaagcggccagcugcuuugggacacagugacgggggucaacauggcucuguga

SEQ ID NO: 212312 - RNA, 1401 nt, Artificial Sequence; identical to SEQ ID NO: 212285
  derived and/or modified sequence opt5 from neuraminidase__InfluenzaB__AGX17998

SEQ ID NO: 212313 - RNA, 1401 nt, Artificial Sequence; identical to SEQ ID NO: 212278
  derived and/or modified sequence opt5 from neuraminidase__InfluenzaB__AGX18009

SEQ ID NO: 212314 - RNA, 1401 nt, Artificial Sequence; identical to SEQ ID NO: 212311
  derived and/or modified sequence opt5 from neuraminidase__InfluenzaB__AGX18020

SEQ ID NO: 212315 - RNA, 1401 nt, Artificial Sequence; identical to SEQ ID NO: 212278
  derived and/or modified sequence opt5 from neuraminidase__InfluenzaB__AGX18031

SEQ ID NO: 212316 - RNA, 1401 nt, Artificial Sequence
  derived and/or modified sequence opt5 from neuraminidase__InfluenzaB__AGX18042
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucaacugcgccaaugcgucuaacguucaagcugugaauagaagcgccaccaaaggagugacacugcuucugccugaacccgaguggaccuauccucggcucuccugucccggcagcacguuccagaaggcccugcuuauuucuccucaccgcuuuggggaaaccaaaggaaacuccgcuccgcugaucauuagagagcccuucaucgccugcggcccuaaugaauguaagcauuuugcucucacacacuacgccgcgcagcccgggggauauuacaacggcacccggggcgaucgcaauaaacugagacaucugaucagcgucaagcucgggaagauuccuacaguggagaacucuaucuuccacauggccgcuugguccggaagcgccugccaugacggcaaagaguggaccuauauugggguugauggacccgacaauaacgcucugcuuaagaucaaauacggcgaagccuacacggauacauaucacucuuacgcgaauaacauucugcggacccaggaguccgccuguaauugcaucgggggaaacuguuaucucaugauuacagacggcagcgcuuccggcgugucugaaugccgcuuucugaagaucagagaggggcggaucauuaaagagaucuucccgaccggacgcgucaagcacaccgaagaguguacaugcggcuuugccagcaauaagacgauugaaugugcuugcagagauaacuccuacaccgccaaacggccuuucgugaaacuuaacguugagaucgacacagccgaaauucgccugaugugcaccgauacauaucucgacacccccagaccugaugacgggagcaucacgggacccugugagucuaauggcgauaagggguccggaggcaucaagggcggguuugugcaucaacggauggcuagcaaaauuggacgcugguacucuagaacaaugagcaagaccgagcggaugggcauggggcuguaugucaaauacgacggagaccccugggcggauuccgacgcccuggcuuucucuggcgugauggugagcaugaaggaaccugggugguacuccuuuggcuucgagaucaaggauaaaaagugcgacgucccguguauuggaaucgaaaugguucacgauggcgggaaagagaccuggcauagcgccgccacagcuauuuauugccucaugggaucuggccagcugcuuugggacaccgugacagggguggauauggcccuguga

SEQ ID NO: 212317 - RNA, 1401 nt, Artificial Sequence; identical to SEQ ID NO: 212285
  derived and/or modified sequence opt5 from neuraminidase__InfluenzaB__AGX18053

SEQ ID NO: 212318 - RNA, 1401 nt, Artificial Sequence; identical to SEQ ID NO: 212285
  derived and/or modified sequence opt5 from neuraminidase__InfluenzaB__AGX18064

SEQ ID NO: 212319 - RNA, 1401 nt, Artificial Sequence
  derived and/or modified sequence opt5 from neuraminidase__InfluenzaB__AGX18075
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccgucaagcucgggaaaauucccacaguggagaacagcaucuuccacauggccgcuuggucuggauccagcugccaugauggcaaggaguggaccuauauugggguugacggaccggauaauaacgcccugcuuaaaaucaaguacggcgaggcuuacacggacacauaucacucuuacgccaauaacauucugcggacccaggaguccgcguguaauugcaucgggggaaacuguuaucucaugauuacagauggcagcgccuccggcgugucugaaugccgcuuucugaaaaucagagaggggcggaucauuaaggagaucuucccuaccggacgcgucaagcacaccgaagaguguacaugcggcuuugcuagcaauaaaacgauugaaugugccugcagagacaacuccuacaccgcuaagcggcccuucgugaaacuuaauguugagacagauaccgccgaaauccgccugaugugcacagagaccuaucucgacacgccuagacccgaugacgggagcauuacaggacccugugagucuaacggcgauaagggguccggaggcaucaaaggcggguuugugcaucaacggauggccagcaagaucggacgcugguacucuagaaccaugagcaaaaccaagcggaugggcauggggcuguaugucaaguacgacggagacccuugggcugauuccgacgcgcuggccuucucuggcgugauggugagcauggaagaaccggggugguacuccuuuggcuucgaaauuaaagauaagaaaugcgacguccccuguaucggaauugagaugguucacgauggcgggaaggaaacauggcauagcgcugccaccgccaucuauugccucaugggaucuggccagcugcuuugggacacagugacgggggugaacauggcucuguga

SEQ ID NO: 212320 - RNA, 1401 nt, Artificial Sequence; identical to SEQ ID NO: 211912
  derived and/or modified sequence opt5 from neuraminidase__InfluenzaB__AGX18086

SEQ ID NO: 212321 - RNA, 1401 nt, Artificial Sequence; identical to SEQ ID NO: 211912
  derived and/or modified sequence opt5 from neuraminidase__InfluenzaB__AGX18097

SEQ ID NO: 212322 - RNA, 1401 nt, Artificial Sequence; identical to SEQ ID NO: 211865
  derived and/or modified sequence opt5 from neuraminidase__InfluenzaB__AGX18108

SEQ ID NO: 212323 - RNA, 1401 nt, Artificial Sequence
  derived and/or modified sequence opt5 from neuraminidase__InfluenzaB__AGX18119
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacaccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaacgaauguaagcauuuugcccucacccacuacgcugcccagcccgggggauauuacaauggcacacggggcgaccgcaacaaacugagacaucugaucagcgucaagcucgggaagauuccuaccguggaaaauucuaucuuccacauggcggccugguccggaagcgcuugccaugauggcaaagaguggacguauauugggguugacggacccgauaacaaugcccugcuuaagaucaaauacggcgaggcuuacacagacaccuaucacucuuacgccaacaauauucugcggacacaggaguccgcguguaacugcaucgggggaaauuguuaucucaugauuaccgauggcagcgccuccggcgugucugaaugccgcuuucugaagaucagagaggggcggaucauuaaagagaucuucccgaccggacgcgucaagcacacagaagaguguacgugcggcuuugcuagcaacaagaccauugaaugugccugcagagacaauuccuacacagcuaaacggccuuucgugaaacuuaacauggagaccgauacagccgaaaucaagcugaugugcaccgacacguaucucgauacaccccgcccugacgaugggagcauuaccggacccugugagucuaacggcgacaagggguccggaggcaucaaaggcggguuuguucaucaaagaauggccagcaagaucggacggugguacucucgcaccaugagcaaaacagagagaaugggcauggggcuguaugugaaguacgacggagaucccugggcugacuccgaugcgcuggccuucucuggcgucauggugagcaugaaggaaccugggugguacuccuuuggcuucgagauuaaagacaagaaaugcgaugugccguguaucggaauugaaaugguccacgacggcgggaaggagaccuggcauagcgcugccacagccaucuauugccucaugggaucuggccagcugcuuugggauacgguuaccgggguggacauggcucuguga

SEQ ID NO: 212324 - RNA, 1401 nt, Artificial Sequence
  derived and/or modified sequence opt5 from neuraminidase__InfluenzaB__AGX18130
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagaucgauacagccgaaauucgccugaugugcaccgacacauaucucgauacccccagaccugacgaugggagcaucacgggacccugugagucuaacggcgacaagggguccggaggcaucaagggcggguuugugcaucaacggauggcuagcaaaauuggacgcugguacucuagaacaaugagccggaccgagagaaugggcauggggcuguaugucaaguacgacggagaucccugggcggacuccgaugcccuggcuuucucuggcgugauggugagcaugaaagaaccugggugguacuccuuuggcuucgagaucaaggacaagaaaugcgaugucccguguauuggaaucgaaaugguucacgacggcgggaaggagaccuggcauagcgccgccacagcuauuuauugccucaugggaucuggccagcugcuuugggauaccgugacagggguggacauggcccuguga

SEQ ID NO: 212325 - RNA, 1401 nt, Artificial Sequence
  derived and/or modified sequence opt5 from neuraminidase__InfluenzaB__AGX18141
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggaaugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgugaagcucgggaaaauuccuacagucgagaacucuaucuuccacauggccgcuugguccggaagcgccugccaugauggcaaggaguggaccuauauugggguggacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcguuucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgugaaacuuaaugucgagacagauaccgccgaaauucgccugaugugcacagagaccuaucucgacacgcccagaccugaugacgggagcaucacaggacccugugagucuaacggcgauaagggguccggaggcaucaaaggcggguuugugcaucaacggauggcuagcaagauuggacgcugguacucuagaaccaugagcaaaaccgaacggaugggcauggggcuguauguuaaguacgacggagaccccugggcggaguccgaugcccuggcuuucucuggcgugauggucagcauggaggaaccugggugguacuccuuuggcuucgaaaucaaggacaaaaagugcgaugugccguguauuggaaucgagauggugcacgacggcgggaaagagacauggcauagcgccgccaccgcuauuuauugccucaugggaucuggccagcugcuuugggauacagucacggggguuaacauggcccuguga

SEQ ID NO: 212326 - RNA, 1401 nt, Artificial Sequence; identical to SEQ ID NO: 211912
  derived and/or modified sequence opt5 from neuraminidase__InfluenzaB__AGX18152

SEQ ID NO: 212327 - RNA, 1401 nt, Artificial Sequence
  derived and/or modified sequence opt5 from neuraminidase__InfluenzaB__AGX18163
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcaagcggggcgaccgcaauaagcugagacaucugaucagcgucaaacucgggaagauuccuaccguggagaacucuaucuuccacauggccgcuugguccggaagcgccugccaugauggcaaagaguggacauauauugggguugacggacccgauaauaacgcucugcuuaagaucaaauacggcgaagccuacaccgacacguaucacucuuacgcgaauaacauucugcggacacaggaguccgccuguaauugcaucgggggaaacuguuaucucaugauuaccgauggcagcgcuuccggcgugucugaaugccgcuuucugaagaucagagaggggcggaucauuaaggagaucuucccgacaggacgcauuaaacacaccgaagaguguaccugcggcuuugccagcaauaagacaaucgaaugugcuugcagagacaacuccuacacggccaaacggccuuucgucaaacuuaauguggagaccgauacagccgaaauucgccugaugugcaccgagacauaucucgacacccccagaccugaugacgggagcaucacgggacccugugagucuaacggcgauaagggguccggaggcaucaagggcggguuuguucaucaacggauggcuagcaaaauuggacgcugguacucuagaacaaugagcaagaccgaacggaugggcauggggcuguaugugaaguacgacggagaccccugggcggauuccgacgcccuggcuuucucuggcgucauggugagcauggaggaaccugggugguacuccuuuggcuucgagaucaaagauaagaaaugcgacgugccguguauuggaaucgaaaugguccacgauggcgggaaggagaccuggcauagcgccgccacagcuauuuauugccucaugggaucuggccagcugcuuugggacaccguuacaggggugaacauggcccuguga

SEQ ID NO: 212328 - RNA, 1401 nt, Artificial Sequence; identical to SEQ ID NO: 212278
  derived and/or modified sequence opt5 from neuraminidase__InfluenzaB__AGX18174

SEQ ID NO: 212329 - RNA, 1401 nt, Artificial Sequence; identical to SEQ ID NO: 211912
  derived and/or modified sequence opt5 from neuraminidase__InfluenzaB__AGX18185

SEQ ID NO: 212330 - RNA, 1401 nt, Artificial Sequence; identical to SEQ ID NO: 211865
  derived and/or modified sequence opt5 from neuraminidase__InfluenzaB__AGX18196

SEQ ID NO: 212331 - RNA, 1401 nt, Artificial Sequence
  derived and/or modified sequence opt5 from neuraminidase__InfluenzaB__AGX18207
augcugcccagcaccauccagacacucacgcuguuccuuaccuccggcggggugcugcucucucuguacgucagcgccucccuuucuuaucugcucuacagcgacauucugcugaaguuuccuccgacagagaucaccgcucccacaaugccucucgauugcgccaacgcguccaauguucaagcugugaacagaucugccaccaaaggagugacacugcuucugcccgaaccugaguggaccuauccccggcucagcuguccuggcuccacguuccagaaggcccugcuuauuagcccgcaccgcuuuggggaaaccaaaggaaauucugcuccccugaucauuagagagccuuucaucgccugcggccccaaggaauguaaacauuuugcucucacacacuacgccgcgcagccugggggauauuacaacggcacccggggcgaccgcaauaagcugagacaucugaucuccgucaagcucgggaaaauucccacaguggagaccagcaucuuccacauggccgcuuggucuggauccgccugccaugauggcaaggaguggacguauauugggguugacggaccggauaacaaugcucugcuuaaaaucaaguacggcgaagccuacacagacaccuaucacagcuacgcgaacaauauucugcggacacaggagucugccuguaacugcaucgggggaaauuguuaucucaugauuaccgauggcuccgcuagcggcguguccgaaugccgcuuucugaaaaucagagaggggcggaucauuaaggagaucuucccuaccggacgcgucaagcacacagaagaguguacgugcggcuuugccucuaacaaaaccauugaaugugcuugcagagacaauagcuacacagccaagcggcccuucgugaaacuuaacguugagaccgauacagccgaaauccgccugaugugcaccgagacguaucucgacacaccuagacccgaugacggguccauuaccggacccugugagagcaauggcgauaaggggucuggaggcaucaaaggcggguuugugcaucaacggauggcuuccaagaucggacgcugguacagcagaaccaugucuaaaacaaagcggaugggcauggggcuguaugucaaguacgacggagacccuugggcggauagcgacgcccuggcuuucuccggcgugauggugucuauggaggaaccggggugguacagcuuuggcuucgaaauuaaagauaagaaaugcgacguccccuguaucggaauugagaugguucacgauggcgggaaggaaaccuggcauuccgccgccacagcuaucuauugccucaugggaagcggccagcugcuuugggacacggugaccggggugaacauggcccuguga

SEQ ID NO: 212332 - RNA, 1401 nt, Artificial Sequence
  derived and/or modified sequence opt5 from neuraminidase__InfluenzaB__AGX18218
augcugcccagcaccauccagacacucacgcuguuccuuaccuccggcggggugcugcucucucuguacgucagcgccucccuuucuuaucugcucuacagcgacauucugcugaagcucuccccuacagagaucaccgcuccgacaaugccccuggauugcgccaacaccucuaauguucaagcggugaacagaagcgcuacaaaaggagugacccuucugcucccugaacccgaguggacguauccucggcuguccugucccggcagcaccuuucagaaggcccuucugauuucuccucaccgcuucggggaaacaaaaggaaauuccgccccgcucaucauuagagagcccuuuaucgcuugcggcccuaacgaauguaagcauuucgcccugacccacuacgcugcccagcccgggggauauuacaaucggacacgcggcgacagaaacaaacugcggcaucucaucagcgucaagcugggcaagauuccuaccguggaaaauucuaucuuucacauggcggccugguccgggagcgcuugccaugauggaaaagaguggacguauauuggcguugacgggcccgauaacaaugcccuucugaagaucaaauacggagaggcuuacacagacaccuaucacucuuacgccaacaauauucuccgcacacaggaguccgcguguaacugcaucggcgggaauuguuaucugaugauuaccgauggaagcgccuccggcgugucugaaugcagauuccuuaagauccgggagggccgcaucauuaaagagaucuuuccgaccgggagagucaagcacacagaagaguguacgugcggauucgcuagcaacaagaccauugaaugugccugccgggacaauuccuacacagcuaaacgcccuuuugugaagcugaacauggagaccgauacagccgaaaucagacucaugugcaccgacacguaucuggauacaccccggccugacgauggcagcauuaccgggcccugugagucuaacggagacaaaggcuccgggggaaucaagggcggcuucguucaucaacgcauggccagcaaaaucgggagaugguacucucggaccaugagcaagacagagagaaugggaaugggccuguaugugaaauacgacggggaucccugggcugacuccgaugcgcucgccuuuucuggagucauggugagcaugaaggaaccuggcugguacuccuucggguuugagauuaaggacaaaaagugcgaugugccguguaucggcauugaaaugguccacgacggaggcaaagagaccuggcauagcgcugccacagccaucuauugccugauggggucuggacagcuucugugggauacgguuaccggcguggacauggcucucuga

SEQ ID NO: 212333 - RNA, 1401 nt, Artificial Sequence; identical to SEQ ID NO: 212285
  derived and/or modified sequence opt5 from neuraminidase__InfluenzaB__AGX18229

SEQ ID NO: 212334 - RNA, 1401 nt, Artificial Sequence
  derived and/or modified sequence opt5 from neuraminidase__InfluenzaB__AGX18240
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaaaccgugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaacgaauguaagcauuuugcccucacccacuacgcugcccagcccgggggauauuacaauggcacacggggcgaccgcaacaaacugagacaucugaucagcgucaagcucgggaagauuccuaccguggaaaauucuaucuuccacauggcggccugguccggaagcgcuugccaugauggcaaagaguggacguauauugggguugacggacccgauaacaaugcccugcuuaagaucaaauacggcgaggcuuacacagacaccuaucacucuuacgccaacaauauucugcggacacaggaguccgcguguaacugcaucgggggaaauuguuaucucaugauuaccgauggcagcgccuccggcgugucugaaugccgcuuucugaagaucagagaggggcggaucauuaaagagaucuucccgaccggacgcgucaagcacacagaagaguguacgugcggcuuugcuagcaacaagaccauugaaugugccugcagagacaauuccuacacagcuaaacggccuuucgugaaacuuaacguugagaucgauaccgccgaaauucgccugaugugcacagacaccuaucucgauacgcccagaccugacgaugggagcaucacaggacccugugagucuaacggcgacaagggguccggaggcaucaagggcggguuugugcaucaacggauggccagcaaaauuggacgcugguacucuagaaccaugagcaagaccgagcggaugggcauggggcuguaugucaaauacgacggagaucccugggcugacuccgaugcgcuggccuucucuggcgugauggugagcaugaaggaaccugggugguacuccuuuggcuucgagaucaaggacaaaaagugcgaugucccguguauuggaaucgaaaugguucacgacggcgggaaagagacauggcauagcgcugccaccgccauuuauugccucaugggaucuggccagcugcuuugggauacagugacggggguggacauggcucuguga

SEQ ID NO: 212335 - RNA, 1401 nt, Artificial Sequence; identical to SEQ ID NO: 212278
  derived and/or modified sequence opt5 from neuraminidase__InfluenzaB__AGX18251

SEQ ID NO: 212336 - RNA, 1401 nt, Artificial Sequence
  derived and/or modified sequence opt5 from neuraminidase__InfluenzaB__AGX18262
augcugcccagcaccauccagacacucacgcuguuccuuaccuccggcggggugcugcucucucuguacgucagcgccucccuuucuuaucugcucuacagcaacauucugcugaaguuuuccccuacagagaucaccgcuccgacaaugccccucgacugcgccaaugcgucuaacguucaagcugugaauagaagcgccaccaaaggagugacacugcuucugccugaacccgaguggaccuauccucggcucuccugucccggcagcacguuccagaaggcccugcuuauuucuccucaccgcuuuggggaaaccaaaggaaacuccgcuccgcugaucauuagagagcccuucaucgccugcggcccuaaugaauguaagcauuuugcucucacacacuacgccgcgcagcccgggggauauuacaacggcacccggggcgaucgcaauaaacugagacaucugaucagcgucaagcucgggaagauuccuacaguggagaacucuaucuuccacauggccgcuugguccggaagcgccugccaugacggcaaagaguggaccuauauugggguugauggacccgacaauaacgcucugcuuaagaucaaauacggcgaagccuacacggauacauaucacucuuacgcgaauaacauucugcggacccaggaguccgccuguaauugcaucgggggaaacuguuaucucaugauuacagacggcagcgcuuccggcgugucugaaugccgcuuucugaagaucagagaggggcggaucauuaaagagaucuucccgaccggacgcgucaagcacaccgaagaguguacaugcggcuuugccagcaauaagacgauugaaugugcuugcagagauaacuccuacaccgccaaacggccuuucgugaaacuuaacguugagacagacaccgccgaaauccgccugaugugcacagauaccuaucucgacacgcccagaccugaugacgggagcauuacaggacccugugagucuaauggcgauaagggguccggaggcaucaagggcggguuugugcaucaacggauggcuagcaaagucggacgcugguacucuagaaccaugagcaagaccgagcggaugggcauggggcuguaugugaaauacgacggagaccccugggcggauuccgacgcccuggcuuucucuggcgugauggucagcaugaaggaaccugggugguacuccuuuggcuucgagaucaaggauaaaaagugcgacguuccguguauuggaaucgaaauggugcacgauggcgggaaagagacauggcauagcgccgccaccgcuauuuauugccucaugggaucuggccagcugcuuugggacacagugacgggggucgauauggcccuguga

SEQ ID NO: 212337 - RNA, 1401 nt, Artificial Sequence; identical to SEQ ID NO: 212285
  derived and/or modified sequence opt5 from neuraminidase__InfluenzaB__AGX18273

SEQ ID NO: 212338 - RNA, 1401 nt, Artificial Sequence; identical to SEQ ID NO: 212310
  derived and/or modified sequence opt5 from neuraminidase__InfluenzaB__AGX18284

SEQ ID NO: 212339 - RNA, 1401 nt, Artificial Sequence; identical to SEQ ID NO: 212285
  derived and/or modified sequence opt5 from neuraminidase__InfluenzaB__AGX18295

SEQ ID NO: 212340 - RNA, 1401 nt, Artificial Sequence; identical to SEQ ID NO: 211912
  derived and/or modified sequence opt5 from neuraminidase__InfluenzaB__AGX18306

SEQ ID NO: 212341 - RNA, 1401 nt, Artificial Sequence
  derived and/or modified sequence opt5 from neuraminidase__InfluenzaB__AGX18317
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacgagacccggggcgaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauaauaacgcucugcuuaaaaucaaguacggagaggccuacacggacacauaucacucuuacgcgaauaacauucugcggacccaggaauccgccuguaauugcaucggcgggaacuguuaucucaugauuacagauggaagcgcuuccggcgugucugagugccgcuuucugaaaaucagagagggccggaucauuaaggaaaucuucccgaccgggcgcauuaagcacaccgaggaauguacaugcggauuugccagcaauaaaacgaucgagugugcuugcagagacaacuccuacaccgccaagcggccuuucgucaaacuuaauguggaaacagauaccgccgagauucgccugaugugcacagagaccuaucucgacacgcccagaccugaugacggcagcaucacagggcccugugaaucuaacggagauaagggcuccgggggaaucaaaggcggcuuuguucaucaacggauggcuagcaagauugggcgcugguacucuagaaccaugagcaaaaccaagcggaugggaaugggccuguaugugaaguacgacggggaccccugggcggauuccgacgcccuggcuuucucuggagucauggugagcauggaggaaccuggcugguacuccuuuggguucgagaucaaagauaagaaaugcgacgugccguguauuggcaucgaaaugguccacgauggaggcaaggagacauggcauagcgccgccaccgcuauuuauugccucauggggucuggacagcugcuuugggacacaguuacgggcgugaacauggcccuguga

SEQ ID NO: 212342 - RNA, 1401 nt, Artificial Sequence; identical to SEQ ID NO: 212285
  derived and/or modified sequence opt5 from neuraminidase__InfluenzaB__AGX18328

SEQ ID NO: 212343 - RNA, 1401 nt, Artificial Sequence
  derived and/or modified sequence opt5 from neuraminidase__InfluenzaB__AGX18339
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaucaacggauggcuagcaaagucggacgcugguacucuagaaccaugagcaagaccgagcggaugggcauggggcuguaugugaaauacgacggagaucccugggcggacuccgaugcccuggcuuucggcggggugauggucucuaugaaggaaccuggcugguacagcuuuggauucgagaucaaggacaaaaagugcgauguuccguguauuggcaucgaaauggugcacgacgggggaaaagagacauggcauuccgccgccaccgcuauuuauugccucaugggcagcgggcagcugcuuugggauacagugacgggagucgacauggcccuguga

SEQ ID NO: 212344 - RNA, 1401 nt, Artificial Sequence
  derived and/or modified sequence opt5 from neuraminidase__InfluenzaB__AGX18350
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcuaugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgugaagcucgggaagauuccuacagucgaaaauucuaucuuccacauggccgcuugguccggaagcgccugccaugauggcaaagaguggaccuauauugggguggacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcguuucugaaugccgcuuucugaagaucagagaggggcggaucauuaaagagaucuucccgaccggacgcgugaagcacaccgaagaguguacaugcggcuuugccagcaacaagacgauugaaugugcuugcagagacaauuccuacaccgccaaacggccuuucgucaaacuuaacguggagaucgauacagccgaaauucgccugaugugcaccgacacauaucucgauacccccagaccugacgaugggagcaucacgggacccugugagucuaacggcgacaagggguccggaggcaucaagggcggguuuguucaucaacggauggcuagcaaaauuggacgcugguacucuagaacaaugagcaagaccgagcggaugggcauggggcuguaugugaaauacgacggagaucccugggcggacuccgaugcccuggcuuucucuggcgucauggugagcaugaaggaaccugggugguacuccuuuggcuucgagaucaaggacaaaaagugcgaugugccguguauuggaaucgaaaugguccacgacggcgggaaagagaccuggcauagcgccgccacagcuauuuauugccucaugggaucuggccagcugcuuugggauaccguuacagggguggacauggcccuguga

SEQ ID NO: 212345 - RNA, 1401 nt, Artificial Sequence; identical to SEQ ID NO: 212310
  derived and/or modified sequence opt5 from neuraminidase__InfluenzaB__AGX18361

SEQ ID NO: 212346 - RNA, 1401 nt, Artificial Sequence
  derived and/or modified sequence opt5 from neuraminidase__InfluenzaB__AGX18383
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacaccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaacgaauguaagcauuuugcccucacccacuacgcugcccagcccgggggauauuacaauggcacacggggcgaccgcaacaaacugagacaucugaucagcgucaagcucgggaagauuccuaccguggaaaauucuaucuuccacauggcggccugguccggaagcgcuugccaugauggcaaagaguggacguauauugggguugacggacccgauaacaaugcccugcuuaagaucaaauacggcgaggcuuacacagacaccuaucacucuuacgccaacaauauucugcggacacaggaguccgcguguaacugcaucgggggaaauuguuaucucaugauuaccgauggcagcgccuccggcgugucugaaugccgcuuucugaagaucagagaggggcggaucauuaaagagaucuucccgaccggacgcgucaagcacacagaagaguguacgugcggcuuugcuagcaacaagaccauugaaugugccugcagagacaauuccuacacagcuaaacggccuuucgugaaacuuaacauggagaccgauacagccgaaauccgccugaugugcaccgacacguaucucgauacacccagaccugacgaugggagcauuaccggacccugugagucuaacggcgacaagggguccggaggcaucaagggcggguuuguucaucaacggauggccagcaaaaucggacgcugguacucuagaaccaugagcaagacagagcggaugggcauggggcuguaugugaaauacgacggagaucccugggcugacuccgaugcgcuggucuucucuggcgugauggugagcaugaaggaaccugggugguacuccuuuggcuucgagauuaaggacaaaaagugcgaugucccguguaucggaauugaaaugguucacggcgggggaaaagagaccuggcauagcgccgcuacagccaucuauugccucaugggcucugggcagcugcuuugggacacggugaccggaguggauauggcccuguga

SEQ ID NO: 212347 - RNA, 1401 nt, Artificial Sequence; identical to SEQ ID NO: 211912
  derived and/or modified sequence opt5 from neuraminidase__InfluenzaB__AGX18394

SEQ ID NO: 212348 - RNA, 1401 nt, Artificial Sequence
  derived and/or modified sequence opt5 from neuraminidase__InfluenzaB__AGX18405
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacaccucugcuucccgaaccugaguggaccuauccccggcuguccuguccuggcagcacguuccaaaaggcccuccugauuucuccgcaucgcuuuggggaaaccaaaggaaauuccgcuccccuuaucauuagagagccuuucaucgccugcggccccaacgaauguaagcacuuugcucugacacauuacgccgcgcagccugggggauauuacaauggcacccggggcgaccgcaacaaacucagacaccugaucagcgucaagcuggggaagauucccacaguggaaaauucuaucuuccauauggccgcuugguccggaagcgccugccacgauggcaaagaguggaccuauauugggguugacggaccggauaacaaugcucuccugaagaucaaauacggcgaggccuacacggacacauaucacucuuacgcgaacaauauucuucggacccaggaguccgccuguaacugcaucgggggaaauuguuaucugaugauuacagauggcagcgcuuccggcgugucugaaugccgcuuucucaagaucagagaggggcggaucauuaaagagaucuucccuaccggacgcgucaagcauaccgaagaguguacaugcggcuuugccagcaacaagacgauugaaugugugugcagagacaauuccuacaccgcuaaacggcccuucguuaagcugaacguggagacagauaccgccgaaauccgccuuaugugcacagacaccuaucuggauacgccuagacccgacgaugggagcauuacaggacccugugagucuaacggcgacaaaggguccggaggcaucaagggcggguuuguccaccagcggauggccagcaaaaucggacgcugguacucuagaaccaugagcaagaccgagcggaugggcauggggcucuaugugaaauacgacggagauccuugggcugacuccgaugcgcuggccuucucuggcgugauggucagcaugaaggaaccggggugguacuccuuuggcuucgagauuaaggacaaaaagugcgauguucccuguaucggaauugaaauggugcaugacggcgggaaagagacauggcacagcgcugccaccgccaucuauugccugaugggaucuggccaacuccugugggauacagugacgggggucgacauggcucuuuga

SEQ ID NO: 212349 - RNA, 1401 nt, Artificial Sequence
  derived and/or modified sequence opt5 from neuraminidase__InfluenzaB__AGX18416
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagaucgauacagccgaaauucgccugaugugcaccgacacauaucucgauacccccagaccugacgaugggagcaucacgggaucuugugaguccaacggcgacaaggggagcggaggcaucaagggcggguuugugcaucaacggauggcuucuaaaauuggacgcugguacagcagaacaauguccaagaccgagcggaugggcauggggcuguaugucaaauacgacggagaucccugggcggacucugaugcccuggcuuucagcggcgugaugguguccaugaaggaacccgggugguacagcuuuggcuucgagaucaaggacaaaaagugcgaugucccuuguauuggaaucgaaaugguucacgacggcgggaaagagaccuggcauucugccgccacagcuauuuauugccucaugggauccggccagcugcuuugggauaccgugacagggguggacauggcccuguga

SEQ ID NO: 212350 - RNA, 1401 nt, Artificial Sequence
  derived and/or modified sequence opt5 from neuraminidase__InfluenzaB__AGX18428
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaacaaaaggaaauuccgcuccucugaucauuagagagccguucaucgccugcggccccaaggaauguaaacauuuugcucucacccacuacgccgcgcagccugggggauauuacaacggcacacgggaggaccgcaauaagcugagacaucugaucagcgucaagcucggcaaaauucccaccguggagaacucuaucuuccacauggccgcuugguccgggagcgccugccaugauggaaaggaauggacguauauuggcguugacgggccugauucuaaugcucugcuuaaaaucaaguacggagaggccuacacagacaccuaucacuccuacgcgaacaauauucugcggacacaggaaagcgccuguaacugcaucggcgggaauuguuaucucaugauuaccgauggauccgcuucuggcaucagcgagugccgcuuucugaaaaucagagagggccggauuaucaaggaaauuuuccccaccgggcgcgugaagcacacagaggaauguacgugcggauuugccuccaacaaaaccaucgagugugcuugcagagacaauagcuacacagccaagcggccguucgucaaacuuaacguggaaaccgauacagccgagauucgccugaugugcaccgagacguaucucgacacaccuagacccgaugacggcucuaucaccgggccuugugaauccaauggaaacaagggcagcgggggaaucaaaggcggcuuuguucaucaacggauggcuucuaagauugggcgcugguacagcagaaccauguccaaaacaaagcggaugggaaugggccuguaugugaaguacgauggggaccccuggaucgacucugaugcgcuggcccucagcggagucaugguguccauggaggaacccggcugguacagcuucggguuugagauuaaagacaagaaaugcgaugugccuuguaucggcauugaaaugguccacgacggaggcaaggagaccuggcauucugcugccacagccaucuauugccugaugggguccggacagcuucugugggauacgguuaccggcguggacauggcucucuga

SEQ ID NO: 212351 - RNA, 1401 nt, Artificial Sequence
  derived and/or modified sequence opt5 from neuraminidase__InfluenzaB__AGX18439
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagaucgauacagccgaaauucgccugaugugcaccgacacauaucucgauacccccagaccugacgaugggagcaucacgggacccugugagucuaacggcgacaagggguccggaggcaucaagggcggguuugugcaucaacggauggcuagcaaaauuggacgcugguacucuagaacaaugagcaagaccgagcggaugggcauggggcuguaugucaaauacgacggagaucccugggcggacuccgaugcccuggcuuucucuggccucauggugagcaugaaggaaccugggugguacuccuuuggcuucgagaucaaggacaaaaagugcgaugugccguguauuggaaucgaaaugguccacgacggcgggaaagagaccuggcauagcgccgccacagcuauuuauugccugaugggaucuggccagcuucugugggauaccguuacagggguggacauggcccucuga

SEQ ID NO: 212352 - RNA, 1401 nt, Artificial Sequence
  derived and/or modified sequence opt5 from neuraminidase__InfluenzaB__AGX18450
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuucuacaaugccgcucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgaacaauauucugcggacccaggagagcgccuguaacugcaucgggggaaauuguuaucucaugauuacagauggcuccgcuucuggcgugagcgaaugccgcuuucugaagaucagagaggggcggaucauuaaagagaucuuccccaccggacgcgucaagcacaccgaagaguguacaugcggcuuugccuccaacaagacgauugaaugugcuugcagagacaauagcuacaccgccaaacggccguucgugaaacuuaacguugagaucgauacagccgaaauucgccugaugugcaccgacacauaucucgauaccccuagacccgacgaugggucuaucacgggaccuugugaguccaacggcgacaaggggagcggaggcaucaagggcggguuugugcaucaacggauggcuucuaaaauuggacgcugguacagcagaacaauguccaagaccgagcggaugggcauggggcuguaugucaaauacgacggagaucccugggcggacucugaugcccuggcuuucagcggcgugaugguguccaugaaggaacccgggugguacagcuuuggcuucgagaucaaggacaaaaagugcgaugucccuuguauuggaaucgaaaugguucacgacggcgggaaagagaccuggcauucugccgccacagcuauuuauugccucaugggauccggccagcugcuuugggauaccgugacagggguggacauggcccuguga

SEQ ID NO: 212353 - RNA, 1401 nt, Artificial Sequence; identical to SEQ ID NO: 211912
  derived and/or modified sequence opt5 from neuraminidase__InfluenzaB__AGX18461

SEQ ID NO: 212354 - RNA, 1401 nt, Artificial Sequence
  derived and/or modified sequence opt5 from neuraminidase__InfluenzaB__AGX18472
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaaccauagcgccaccaaaggagugacaccucugcuucccgaaccugaguggaccuaucccagacuguccuguccuggcagcacguuccaaaaggcccuccugauuucuccgcaccgguuuggggaaaccaaaggaaauuccgcuccccuuaucauucgcgagccuuucaucgccugcggccccaacgaauguaagcauuuugcucugacacacuacgccgcgcagccugggggauauuacaauggcaccagaggcgaccggaacaaacuccgccaucugaucagcgucaagcuggggaagauucccacaguggaaaauucuaucuuccacauggccgcuugguccggaagcgccugccacgauggcaaagaguggaccuauauugggguugacggaccggauaacaaugcucuccugaagaucaaauacggcgaggccuacacggacacauaucauucuuacgcgaacaauauucuuagaacccaggaguccgccuguaacugcaucgggggaaauuguuaucugaugauuacagauggcagcgcuuccggcgugucugaaugccgguuucucaagauccgcgaggggagaaucauuaaagagaucuucccuaccggacgggucaagcacaccgaagaguguacaugcggcuuugccagcaacaagacgauugaaugugcuugccgcgacaauuccuacaccgccaaaagacccuucgugaagcugaacguugagacagauaccgccgaaauccggcuuaugugcacagacaccuaucuggauacgccucgccccgacgaugggagcauuacaggacccugugagucuaacggcgacaaaggguccggaggcaucaagggcggguuugugcaucagagaauggcuagcaaaaucggacggugguacucucgcaccaugagcaagaccgagagaaugggcauggggcucuaugucaaauacgacggagauccuugggcggacuccgaugcccuggcuuucucuggcgugauggugagcaugaaggaaccggggugguacuccuuuggcuucgagauuaaggacaaaaagugcgauguccccuguaucggaauugaaaugguucacgacggcgggaaagagacauggcacagcgccgccaccgcuaucuauugccugaugggaucuggccaacuccugugggauacagugacggggguggacauggcccuuuga

SEQ ID NO: 212355 - RNA, 1401 nt, Artificial Sequence; identical to SEQ ID NO: 211912
  derived and/or modified sequence opt5 from neuraminidase__InfluenzaB__AGX18483

SEQ ID NO: 212356 - RNA, 1401 nt, Artificial Sequence; identical to SEQ ID NO: 211659
  derived and/or modified sequence opt5 from neuraminidase__InfluenzaB__AGX18494

SEQ ID NO: 212357 - RNA, 1401 nt, Artificial Sequence
  derived and/or modified sequence opt5 from neuraminidase__InfluenzaB__AGX18505
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggcuagcaagaucggacgcugguacucuagaaccauuagcaaaaccgagcggaugggcauggggcuguaugucaaguacgacggagaucccugggcggacuccgaugcccuggcuuucucuggcgugauggugagcaugaaggaaccugggugguacuccuuuggcuucgagaucaaagacaagaaaugcgaugucccguguauuggaaucgaaaugguucacgacggcgggaaggagacauggcauagcgccgccaccgcuauuuauugccucaugggaucuggccagcugcuuugggauacagugacggggguggacauggcccuguga

SEQ ID NO: 212358 - RNA, 1401 nt, Artificial Sequence
  derived and/or modified sequence opt5 from neuraminidase__InfluenzaB__AGX18516
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggcuagcaagaucggacgcugguacucuagaaccauuagcaaaaccgagcggaugggcauggggcuguaugucaaguacgacggagaucccugggcggacuccgaugcccuggcuuucucuggcgugauggugagcaugaaggaaccugggugguacuccuuuggcuucgagaucaaagacaagaaaugcgaugucccguguauuggaaucgaaaugguucacggcgggggaaaggagacauggcauagcgccgccaccgcuauuuauugccucaugggcucugggcagcugcuuugggacacagugacgggaguggauauggcccuguga

SEQ ID NO: 212359 - RNA, 1401 nt, Artificial Sequence; identical to SEQ ID NO: 211659
  derived and/or modified sequence opt5 from neuraminidase__InfluenzaB__AGX18527

SEQ ID NO: 212360 - RNA, 1401 nt, Artificial Sequence; identical to SEQ ID NO: 211659
  derived and/or modified sequence opt5 from neuraminidase__InfluenzaB__AGX18538

SEQ ID NO: 212361 - RNA, 1401 nt, Artificial Sequence; identical to SEQ ID NO: 211659
  derived and/or modified sequence opt5 from neuraminidase__InfluenzaB__AGX18549

SEQ ID NO: 212362 - RNA, 1401 nt, Artificial Sequence; identical to SEQ ID NO: 211659
  derived and/or modified sequence opt5 from neuraminidase__InfluenzaB__AGX18560

SEQ ID NO: 212363 - RNA, 1401 nt, Artificial Sequence; identical to SEQ ID NO: 211659
  derived and/or modified sequence opt5 from neuraminidase__InfluenzaB__AGX18571

SEQ ID NO: 212364 - RNA, 1401 nt, Artificial Sequence
  derived and/or modified sequence opt5 from neuraminidase__InfluenzaB__AGX18582
augcugcccagcaccauccagacacucacgcuguuccuuaccuccggcggggugcugcucucucuguacguccuugccagccuguccuaucuccuguacucugacauucugcucaaguuuagcccuacagagaucaccgcuccgacaaugccccuggauugcgccaacgcguccaauguucacgcugugaacagaucugccaccaaaggagugacacuucugcucccugaacccgagugggccuauccucggcugagcugucccggcuccaccuuccaaaaggcccuucugauuagcccucaucgcuuuggggaaacgaaaggaaauucugcuccgcucaucauuagagagcccuucaucgcuugcggcccuaacgaauguaagcacuuugcccugacccauuacgcggcccagcccgggggauauuacaauggcacacggggcgaccgcaacaaacugagacaccucaucuccgucaagcuggggaagauuccuaccguggagaauagcaucuuccauauggcugccuggucuggauccgcuugccacgauggcaaagaguggacauauauugggguugacggacccgauaacaaugcccuucugaagaucaaauacggcgaagcguacaccgacacguaucacagcuacgccaacaauauucuccggacacaggagucugcuuguaacugcaucgggggaaauuguuaucugaugauuaccgauggcuccgccagcggcguguccgaaugccgcuuucuuaagaucagagaggggcggaucauuaaagagaucuucccgacaggacgcgucaagcauaccgaagaguguaccugcggcuuugcuucuaacaagacaauugaaugugccugcagagacaauagcuacacggccaaacggccuuucgugaagcugaacguugagaccgauacagcugaaauccgccucaugugcaccgacacauaucuggauacccccagaccugacgauggguccauuacgggacccugugagagcaacggcgacaaagggucuggaggcaucaagggcggguuugugcaccagcggauggcguccaaaaucggacgcugguacagcagaacaaugucuaagaccgagcggaugggcauggggcuguaugucaaauacgacggagaucccugggccgacagcgaugcucucgccuucuccggcgugauggugucuaugaaggaaccugggugguacagcuuuggcuucgagauuaaggacaaaaagugcgaugucccguguaucggaauugaaaugguucaugacggcgggaaagagaccuggcacuccgccgcuacagccaucuauugccugaugggaagcggccaacuucugugggauaccgugacagggguggacauggcgcucuga

SEQ ID NO: 212365 - RNA, 1401 nt, Artificial Sequence; identical to SEQ ID NO: 211659
  derived and/or modified sequence opt5 from neuraminidase__InfluenzaB__AGX18593

SEQ ID NO: 212366 - RNA, 1401 nt, Artificial Sequence; identical to SEQ ID NO: 211659
  derived and/or modified sequence opt5 from neuraminidase__InfluenzaB__AGX18604

SEQ ID NO: 212367 - RNA, 1401 nt, Artificial Sequence
  derived and/or modified sequence opt5 from neuraminidase__InfluenzaB__AGX18615
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcaacaagggguccggaggcaucaaaggcggguuugugcaucaacggauggcuagcaagaucggacgcugguacucuagaaccaugagcaaaaccgagcggaugggcauggggcuguaugucaaguacgacggagaccccugggcggauuccgacgcccuggcuuucucuggcgugauggugagcaugaaggaaccugggugguacuccuuuggcuucgagauuaaagauaagaaaugcgacgucccguguaucggaauugaaaugguucacgauggcgggaaggagacauggcauagcgccgccaccgcuaucuauugccucaugggaucuggccagcugcuuugggacacagugacggggguggauauggcccuguga

SEQ ID NO: 212368 - RNA, 1401 nt, Artificial Sequence
  derived and/or modified sequence opt5 from neuraminidase__InfluenzaB__AGX18626
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugauccucagagagcccuucauugccugcggcccuaacgaauguaagcauuuugcucugacacacuacgccgcgcagcccgggggauauuacaauggcacccggggcgaccgcaacaaacugagacaucucaucagcgucaagcuggggaagaucccuacaguggaaaauucuauuuuccacauggccgcuugguccggaagcgccugccaugauggcaaagaguggaccuauaucgggguugacggacccgauaacaaugcccuucugaagauuaaauacggcgaggcuuacacggacacauaucacucuuacgcgaacaagauccuccggacccaggaguccgccuguaauugcauugggggaaacuguuaucugaugaucacagauggcagcgcuuccggcgugucugaaugccgcuuucuuaaaauuagagaggggcggaucaucaaggagauuuucccgaccggacgcgucaagcacaccgaagaguguacaugcggcuuugccagcaauaaaacgaucgaaugugcuugcagagacaacuccuacaccgccaagcggccuuucgugaaacugaauguugagacagauaccgccgaaauucgccucaugugcacagacaccuaucuggauacgcccagaccugacgaugggagcaucacaggacccugugagucuaacggcgacaagggguccggaggcauuaaaggcggguuugugcaucaacggauggcuagcaagaucggacgcugguacucuagaaccaugagcaaaaccgagcggaugggcauggggcuguaugucaaguacgacggagaucccugggcggacuccgaugcccucgcuuucucuggcgugauggugagcaugaaggaaccugggugguacuccuuuggcuucgagaucaaagacaagaaaugcgaugucccguguauuggaaucgaaaugguucacgacggcgggaaggagacauggcauagcgccgccaccgcuauuuauugccugaugggaucuggccagcuucugugggauacagugacggggguggacauggcccucuga

SEQ ID NO: 212369 - RNA, 1401 nt, Artificial Sequence; identical to SEQ ID NO: 211659
  derived and/or modified sequence opt5 from neuraminidase__InfluenzaB__AGX18637

SEQ ID NO: 212370 - RNA, 1401 nt, Artificial Sequence; identical to SEQ ID NO: 211659
  derived and/or modified sequence opt5 from neuraminidase__InfluenzaB__AGX18648

SEQ ID NO: 212371 - RNA, 1401 nt, Artificial Sequence; identical to SEQ ID NO: 211659
  derived and/or modified sequence opt5 from neuraminidase__InfluenzaB__AGX18659

SEQ ID NO: 212372 - RNA, 1401 nt, Artificial Sequence; identical to SEQ ID NO: 211659
  derived and/or modified sequence opt5 from neuraminidase__InfluenzaB__AGX18670

SEQ ID NO: 212373 - RNA, 1401 nt, Artificial Sequence
  derived and/or modified sequence opt5 from neuraminidase__InfluenzaB__AGX18681
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucgucagagagcccuucauugccugcggcccuaacgaauguaagcauuuugcucucacacacuacgccgcgcagcccgggggauauuacaauggcacccggggcgaccgcaacaaacugagacaucugaucagcgugaagcucgggaagaucccuacaguugaaaauucuauuuuccacauggccgcuugguccggaagcgccugccaugauggcaaagaguggaccuauaucgggguggacggacccgauaacaaugcucugcuuaagauuaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggguccggaggcauuaaaggcggguuuguccaucaacggauggcuagcaagaucggacgcugguacucuagaaccaugagcaaaaccgagcggaugggcauggggcuguaugugaaguacgacggagaucccugggcggacuccgaugcccuggcuuucucuggcgugauggucagcaugaaggaaccugggugguacuccuuuggcuucgagaucaaagacaagaaaugcgauguuccguguauuggaaucgaaauggugcacgacggcgggaaggagacauggcauagcgccgccaccgcuauuuauugccucaugggaucuggccagcugcuuugggauacagugacgggggucgacauggcccuguga

SEQ ID NO: 212374 - RNA, 1401 nt, Artificial Sequence; identical to SEQ ID NO: 211659
  derived and/or modified sequence opt5 from neuraminidase__InfluenzaB__AGX18692

SEQ ID NO: 212375 - RNA, 1401 nt, Artificial Sequence
  derived and/or modified sequence opt5 from neuraminidase__InfluenzaB__AGX18703
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaaccugagcgccaccaaaggagugacacuucugcucccugaacccgaguggaccuauccuagacuguccugucccggcagcacguuccagaaggcccuucugauuucuccucaccgguuuggggaaaccaaaggaaauuccgcuccgcucaucauucgcgagcccuucaucgccugcggcccuaaggaauguaaacauuuugcucugacacacuacgccgcgcagcccgggggauauuacaacggcaccagaggcgaccggaauaagcugcgccaucucaucagcgucaagcuggggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucucagaacccaggaguccgccuguaauugcaucgggggaaacuguuaucugaugauuacagauggcagcgcuuccggcgugucugaaugccgguuucuuaaaauccgcgaggggagaaucauuaaggagaucuucccgaccggacggauuaagcacaccgaagaguguacaugcggcuuugccagcaauaaaacgaucgaaugugcuugccgcgacaacuccuacaccgccaagagaccuuucgucaaacugaauguggagacagauaccgccgaaauucggcucaugugcacagagaccuaucuggacacgccccgcccugaugacgggagcaucacaggacccugugagucuaacggcgauaagggguccggaggcaucaaaggcggguuuguucaucaaagaauggcuagcaagauuggacggugguacucucgcaccaugagcaaaaccgaaagaaugggcauggggcuguaugugaaguacgacggagaccccugggcggauuccgacgcccucgcuuucucuggcgucauggugagcauggaggaaccugggugguacuccuuuggcuucgagaucaaggauaaaaagugcgacgugccguguauuggaaucgaaaugguccacgauggcgggaaagagacauggcauagcgccgccaccgcuauuuauugccugaugggaucuggccagcuucugugggacacaguuacgggggugaacauggcccucuga

SEQ ID NO: 212376 - RNA, 1401 nt, Artificial Sequence; identical to SEQ ID NO: 211659
  derived and/or modified sequence opt5 from neuraminidase__InfluenzaB__AGX18714

SEQ ID NO: 212377 - RNA, 1401 nt, Artificial Sequence; identical to SEQ ID NO: 211659
  derived and/or modified sequence opt5 from neuraminidase__InfluenzaB__AGX18725

SEQ ID NO: 212378 - RNA, 1401 nt, Artificial Sequence
  derived and/or modified sequence opt5 from neuraminidase__InfluenzaB__AGX18736
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcaccggcggggaccggaacaaacugcgccaucugaucagcgucaagcucggaaagauuccuacaguggaaaauucuaucuuccacauggccgcuugguccggcagcgccugccaugaugggaaagaguggaccuauauuggaguugacggccccgauaacaaugcucugcuuaagaucaaauacggggaggccuacacggacacauaucacucuuacgcgaacaagauucugagaacccaggaguccgccuguaauugcaucggaggcaacuguuaucucaugauuacagauggcagcgcuuccggggugucugaaugccgguuucugaaaauccgcgagggaagaaucauuaaggagaucuucccgaccggccgggucaagcacaccgaagaguguacaugcggguuugccagcaauaaaacgauugaaugugcuugccgcgacaacuccuacaccgccaagagaccuuucgugaaacuuaauguugagacagauaccgccgaaauccggcugaugugcacagacaccuaucucgauacgccccgcccugacgauggaagcauuacaggccccugugagucuaacggggacaagggauccggcggcaucaaagggggauuugugcaucaaagaauggcuagcaagaucggccggugguacucucgcaccaugagcaaaaccgagagaauggggaugggacuguaugucaaguacgacggcgaucccugggcggacuccgaugcccuggcuuucucuggggugauggugagcaugaaggaaccuggcugguacuccuuuggauucgagauuaaagacaagaaaugcgaugucccguguaucggcauugaaaugguucacgacgggggaaaggagacauggcauagcgccgccaccgcuaucuauugccucaugggcucugggcagcugcuuugggauacagugacgggaguggacauggcccuguga

SEQ ID NO: 212379 - RNA, 1401 nt, Artificial Sequence; identical to SEQ ID NO: 211659
  derived and/or modified sequence opt5 from neuraminidase__InfluenzaB__AGX18758

SEQ ID NO: 212380 - RNA, 1401 nt, Artificial Sequence; identical to SEQ ID NO: 211659
  derived and/or modified sequence opt5 from neuraminidase__InfluenzaB__AGX18769

SEQ ID NO: 212381 - RNA, 1401 nt, Artificial Sequence; identical to SEQ ID NO: 212118
  derived and/or modified sequence opt5 from neuraminidase__InfluenzaB__AGX18780

SEQ ID NO: 212382 - RNA, 1401 nt, Artificial Sequence; identical to SEQ ID NO: 211659
  derived and/or modified sequence opt5 from neuraminidase__InfluenzaB__AGX18791

SEQ ID NO: 212383 - RNA, 1401 nt, Artificial Sequence; identical to SEQ ID NO: 211659
  derived and/or modified sequence opt5 from neuraminidase__InfluenzaB__AGX18802

SEQ ID NO: 212384 - RNA, 1401 nt, Artificial Sequence
  derived and/or modified sequence opt5 from neuraminidase__InfluenzaB__AGX18813
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccgaacggaugggcauggggcuguaugugaaguacgacggagaccccugggcggauuccgacgcccuggucuucucuggcgugauggugagcauggaggaaccugggugguacuccuuuggcuucgagaucaaggauaaaaagugcgacgucccguguauuggaaucgaaaugguucacgauggcgggaaagagacauggcauagcgcugccaccgccauuuauugccucaugggaucuggccagcugcuuugggacacagugacgggggugaacauggcucuguga

SEQ ID NO: 212385 - RNA, 1401 nt, Artificial Sequence; identical to SEQ ID NO: 212118
  derived and/or modified sequence opt5 from neuraminidase__InfluenzaB__AGX18824

SEQ ID NO: 212386 - RNA, 1401 nt, Artificial Sequence
  derived and/or modified sequence opt5 from neuraminidase__InfluenzaB__AGX18846
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucuguccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgaacaagauucugcggacccaggagagcgccuguaauugcaucgggggaaacuguuaucucaugauuacagauggcuccgcuucuggcgugagcgaaugccgcuuucugaaaaucagagaggggcggaucauuaaggagaucuuccccaccggacgcgucaagcacaccgaagaguguacaugcggcuuugccuccaauaaaacgauugaaugugcuugcagagacaacagcuacaccgccaagcggccguucgugaaacuuaauguugagacagauaccgccgaaauccgccugaugugcacagacaccuaucucgauacgccuagacccgacgaugggucuauuacaggaccuugugaguccaacggcgacaaggggagcggaggcaucaaaggcggguuugugcaucaacggauggcuucuaagaucggacgcugguacagcagaaccauguccaaaaccgagcggaugggcauggggcuguaugucaaguacgacggagaucccugggcggacucugaugcccuggcuuucagcggcgugaugguguccaugaaggaacccgggugguacagcuuuggcuucgagauuaaagacaagaaaugcgaugucccuuguaucggaauugaaaugguucacgacggcgggaaggagacauggcauucugccgccaccgcuaucuauugccucaugggauccggccagcugcuuugggauacagugacggggguggacauggcccuguga

SEQ ID NO: 212387 - RNA, 1401 nt, Artificial Sequence; identical to SEQ ID NO: 211659
  derived and/or modified sequence opt5 from neuraminidase__InfluenzaB__AGX18857

SEQ ID NO: 212388 - RNA, 1401 nt, Artificial Sequence; identical to SEQ ID NO: 212386
  derived and/or modified sequence opt5 from neuraminidase__InfluenzaB__AGX18868

SEQ ID NO: 212389 - RNA, 1401 nt, Artificial Sequence; identical to SEQ ID NO: 212386
  derived and/or modified sequence opt5 from neuraminidase__InfluenzaB__AGX18879

SEQ ID NO: 212390 - RNA, 1401 nt, Artificial Sequence
  derived and/or modified sequence opt5 from neuraminidase__InfluenzaB__AGX18890
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccgaacggaugggcauggggcuguaugugaaguacgacggagaccccugggcggauuccgacgcccuggcuuucucuggcgucauggugagcauggaggaaccugggugguacuccuuuggcuucgagaucaaggauaaaaagugcgacgugccguguauuggaaucgaaaugguccacgauggcgggaaagagacauggcauagcgccgccaccacaauuuauugccucaugggaucuggccagcugcuuugggacacgguuaccggggugaacauggcucuguga

SEQ ID NO: 212391 - RNA, 1401 nt, Artificial Sequence; identical to SEQ ID NO: 211659
  derived and/or modified sequence opt5 from neuraminidase__InfluenzaB__AGX18912

SEQ ID NO: 212392 - RNA, 1401 nt, Artificial Sequence
  derived and/or modified sequence opt5 from neuraminidase__InfluenzaB__AGX18923
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaaucggacccgcggcgacagaaacaaacugcggcaucugaucagcgucaagcucggcaagauuccuacaguggaaaauucuaucuuccacauggccgcuugguccgggagcgccugccaugauggaaaagaguggauuuauaucggcguugacgggcccgauaacaaugcucugcuuaagauuaaauacggagaggccuacaccgacacguaucacucuuacgcgaacaagauccugcgcacacaggaguccgccuguaauugcauuggcgggaacuguuaucucaugaucaccgauggaagcgcuuccggcgugucugaaugcagauuucugaaaauccgggagggccgcauuaucaaggagauuuucccgacagggagagucaagcacaccgaagaguguaccugcggauuugccagcaauaaaacaaucgaaugugcuugccgggacaacuccuacacggccaagcgcccuuucgugaaacuuaauguugagaccgauacagccgaaauuagacugaugugcaccgacacauaucucgauacgccccggccugacgauggcagcaucaccgggcccugugagucuaacggagacaagggcuccgggggaaucaaaggcggcuuugugcaucaacgcauggcuagcaagauugggagaugguacucucggacaaugagcaaaaccgagagaaugggaaugggccuguaugucaaguacgacggggaucccugggcggacuccgaugcccuggcuuucucuggagugauggugagcaugaaggaaccuggcugguacuccuuuggguucgagaucaaagacaagaaaugcgaugucccguguauuggcaucgaaaugguucacgacggaggcaaggagaccuggcauagcgccgccacagcuauuuauugccucauggggucuggacagcugcuuugggauaccgugacaggcguggacauggcccuguga

SEQ ID NO: 212393 - RNA, 1401 nt, Artificial Sequence; identical to SEQ ID NO: 211659
  derived and/or modified sequence opt5 from neuraminidase__InfluenzaB__AGX18934

SEQ ID NO: 212394 - RNA, 1401 nt, Artificial Sequence
  derived and/or modified sequence opt5 from neuraminidase__InfluenzaB__AGX18956
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacguugccgcuugguccggaagcgccugccaugauggcaaagaguggaccuauauugggguggacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgucucugaaugccgcuuucugaaaaucagagaggggcggaucauuaaggagaucuucccgaccggacgcgugaagcacaccgaagaguguacaugcggcuuugccagcaauaaaacgauugaaugugcuugcagagacaacuccuacaccgccaagcggccuuucguuaaacuuaauguggagacagauaccgccgaaauccgccugaugugcacagacaccuaucucgauacgcccagaccugacgaugggagcauuacaggacccugugagucuaacggcgacaagggguccggaggcaucaaaggcggguuuguccaucaacggauggcuagcaagaucggacgcugguacucuagaaccaugagcaaaaccgagcggaugggcauggggcuguaugugaaguacgacggagaucccugggcggacuccgaugcccuggcuuucucuggcgugauggucagcaugaaggaaccugggugguacuccuuuggcuucgagauuaaagacaagaaaugcgauguuccguguaucggaauugaaauggugcacgacggcgggaaggagacauggcauagcgccgccaccgcuaucuauugccucaugggaucuggccagcugcuuugggauacagugacgggggucgacauggcccuguga

SEQ ID NO: 212395 - RNA, 1401 nt, Artificial Sequence
  derived and/or modified sequence opt5 from neuraminidase__InfluenzaB__AGX18967
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacaccucugcuucccgaaccugaguggaccuauccccggcuguccuguccuggcagcacguuccagaaggcccuccugauuucuccgcaccgcuuuggggaaaccaaaggaaauuccgcuccccuuaucauuagagagccuuucaucgccugcggccccaacgaauguaagcauuuugcucugacacacuacgccgcgcagccugggggauauuacaauggcacccggggcgaccgcaacaaacucagacaucugaucagcgucaagcuggggaagauucccacaguggaaaauucuaucuuccacauggccgcuugguccggaagcgccugccaugauggcaaagaguggaccuauauugggguugacggaccggauaacaaugcucuccugaagaucaaauacggcgaggccuacacggacacauaucacucuuacgcgaacaagauucuucggacccaggaguccgccuguaauugcaucgggggaaacuguuaucugaugauuacagauggcagcgcuuccggcgugucugaaugccgcuuucucaaaaucagagaggggcggaucauuaaggagaucuucccuaccggacgcgucaagcacaccgaagaguguacaugcggcuuugccagcaauaaaacgauugaaugugcuugcagagacaacuccuacaccgccaagcggcccuucgugaaacugaauguugagacagauaccgccgaaauccgccuuaugugcacagacaccuaucuggauacgccuagacccgacgaugggagcauuacaggacccugugagucuaacggcgacaagggguccggaggcaucaaaggcggguuugugcaucaacggauggcuagcaagaucggacgcugguacucuagaaccaugagcaaaaccgagcggaugggcauggggcucuaugucaaguacgacggagauccuugggcggacuccgaugcccuggcuuucucuggcgugauggugagcaugaaggaaccggggugguacuccuuuggcuucgagauuaaagacaagaaaugcgauguccccuguaucggaauugaaaugguucacgacggcgggaaggagacauggcauagcgccgccaccgcuaucuauugccugaugggaucuggccagcuccugugggauacagugacggggguggacauggcccuuuga

SEQ ID NO: 212396 - RNA, 1401 nt, Artificial Sequence; identical to SEQ ID NO: 212118
  derived and/or modified sequence opt5 from neuraminidase__InfluenzaB__AGX18978

SEQ ID NO: 212397 - RNA, 1401 nt, Artificial Sequence
  derived and/or modified sequence opt5 from neuraminidase__InfluenzaB__AGX18989
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauuaugccaacgcgucuaauguucaagcugugaacagaagcgccaccaaaggagugacacugcuucugccugaacccgaguggaccuacccucggcucuccugccccggcagcacguuccagaaggcccugcuuauuucuccucaccgcuuuggggaaaccaaaggaaauuccgcuccgcugaucauuagagagcccuucaucgccuguggcccuaacgaaugcaagcauuuugcucucacacacuaugccgcgcagcccgggggauacuauaauggcacccggggcgaccgcaacaaacugagacaucugaucagcgucaagcucgggaagauuccuacaguggaaaauucuaucuuccacauggccgcuugguccggaagcgccugucaugauggcaaagaguggaccuacauugggguugacggacccgauaacaaugcucugcuuaagaucaaauacggcgaggccuauacggacacauaccacucuuaugcgaacaagauucugcggacccaggaguccgccugcaauuguaucgggggaaacugcuaccucaugauuacagauggcagcgcuuccggcgugucugaaugucgcuuucugaaaaucagagaggggcggaucaccaaggagauuuucccgaccggacgcgucaagcacacagaagagugcacguguggcuuugccagcaauaaaaccaucgaaugcgcuuguagagacaacuccuauacagccaagcggccuuucgugaaacuuaauguugagaccgauacagccgaaauucgccugaugugcaccgacacguaccucgauacacccagaccugacgaugggagcaucaccggacccugcgagucuaacggcgacaagggguccggaggcauuaaaggcggguuugugcaucaacggauggcuagcaagaucggacgcugguauucuagaaccaugagcaaaacagagcggaugggcauggggcuguacgucaaguacgacggagaucccugggcggacuccgaugcccuggcuuucucuggcgugauggugagcaugaaggaaccugggugguauuccuuuggcuucgagaucaaagacaagaaaugugaugucccgugcauuggaaucgaaaugguucacgacggcgggaaggagaccuggcauagcgccgccacagcuauuuacugucucaugggaucuggccagcugcuuugggauacggugaccgggguggacauggcccuguga

SEQ ID NO: 212398 - RNA, 1401 nt, Artificial Sequence
  derived and/or modified sequence opt5 from neuraminidase__InfluenzaB__AGX19000
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacauacuaugccgcgcagcccgggggauacuauaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuacauugggguugacggacccgauaacaaugcucugcuuaagaucaaauacggcgaggccuauacggacacauaccacucuuaugcgaacaauauucugcggacccaggaguccgccuguaacugcaucgggggaaauuguuaccucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuauaccgccaaacggccuuucgugaaacuuaacguugagacagauaccgccgaaauccgccugaugugcacagacaccuaccucgauacgcccagaccugacgaugggagcauuacaggacccugugagucuaacggcgacaagggguccggaggcaucaagggcggguuugugcaucagcggauggcuagcaaaaucggacgcugguauucuagaaccaugagcaagaccgagcggaugggcauggggcuguacgucaaauacgacggagaucccugggcggacuccgaugcccuggcuuucucuggcgugauggugagcaugaaggaaccugggugguauuccuuuggcuucgagauuaaggacaaaaagugcgaugucccguguaucggaauugaaaugguucacgacggcgggaaagagacauggcauagcgccgccaccgcuaucuacugccucaugggaucuggccaacugcuuugggauacagugacggggguggacauggcccuguga

SEQ ID NO: 212399 - RNA, 1401 nt, Artificial Sequence; identical to SEQ ID NO: 211659
  derived and/or modified sequence opt5 from neuraminidase__InfluenzaB__AGX19011

SEQ ID NO: 212400 - RNA, 1401 nt, Artificial Sequence; identical to SEQ ID NO: 211659
  derived and/or modified sequence opt5 from neuraminidase__InfluenzaB__AGX19022

SEQ ID NO: 212401 - RNA, 1401 nt, Artificial Sequence
  derived and/or modified sequence opt5 from neuraminidase__InfluenzaB__AGX19033
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucaacugcgccaaugcgucuaacguucaagcugugaauagaagcgccaccaaaggagugacacugcuucugccugaacccgaguggaccuauccucggcucuccugucccggcagcacguuccagaaggcccugcuuauuucuccucaccgcuuuggggaaaccaaaggaaacuccgcuccgcugaucauuagagagcccuucaucgccugcggcccuaaggaauguaaacauuuugcucucacacacuacgccgcgcagcccgggggauauuacaauggcacccggggcgaucgcaacaagcugagacaucugaucagcgucaagcucgggaaaauuccuacaguggaaaauucuaucuuccacauggccgcuugguccggaagcgccugccaugacggcaaggaguggaccuauauugggguugauggacccgacaacaaugcucugcuuaaaaucaaguacggcgaagccuacacggauacauaucacucuuacgcgaacaauauucugcggacccaggaguccgccuguaacugcaucgggggaaauuguuaucucaugauuacagacggcagcgcuuccggcgugucugaaugccgcuuucugaaaaucagagaggggcggaucauuaaggagaucuucccgaccggacgcauuaagcacaccgaagaguguacaugcggcuuugccagcaacaaaacgaucgaaugugcuugcagagauaauuccuacaccgccaagcggccuuucgucaaacuuaacguggagacagacaccgccgaaauucgccugaugugcacagagaccuaucucgauacgcccagaccugacgaugggagcaucacaggacccugugagucuaacggcgacaagggguccgaaggaaucaaaggcggcuuuguucaucaacggauggcuagcaagauugggcgcugguacucuagaaccaugagcaaaaccgagcggaugggaaugggccuguaugugaaguacgauggggaccccugggcggacuccgaugcccuggcuuucucuggagucauggugagcauggaggagccuggcugguacuccuuuggguucgaaaucaaggacaaaaagugcgaugugccguguauuggcaucgagaugguccacgacggaggcaaagagacauggcauagcgccgccaccgcuauuuauugccucauggggucuggacagcugcuuugggauacaguuacgggcgugaauauggcccuguga

SEQ ID NO: 212402 - RNA, 1401 nt, Artificial Sequence; identical to SEQ ID NO: 211659
  derived and/or modified sequence opt5 from neuraminidase__InfluenzaB__AGX19044

SEQ ID NO: 212403 - RNA, 1401 nt, Artificial Sequence; identical to SEQ ID NO: 211659
  derived and/or modified sequence opt5 from neuraminidase__InfluenzaB__AGX19055

SEQ ID NO: 212404 - RNA, 1401 nt, Artificial Sequence
  derived and/or modified sequence opt5 from neuraminidase__InfluenzaB__AGX19066
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggauuuauaucgggguugacggacccgauaacaaugcucugcuuaagauuaaauacggcgaggccuacaccgacacguaucacucuuacgcgaacaagauccugcggacacaggaguccgccuguaauugcauugggggaaacuguuaucucaugaucaccgauggcagcgcuuccggcgugucugaaugccgcuuucugaaaaucagagaggggcggauuaucaaggagauuuucccgacaggacgcgucaagcacaccgaagaguguaccugcggcuuugccagcaauaaaacaaucgaaugugcuugcagagacaacuccuacacggccaagcggccuuucgugaaacuuaauguugagaccgauacagccgaaauucgccugaugugcaccgacacauaucucgauacccccagaccugacgaugggagcaucacgggacccugugagucuaacggcgacaagggguccggaggcaucaaaggcggguuugugcaucaacggauggcuagcaagauuggacgcugguacucuagaacaaugagcaaaaccgagcggaugggcauggggcuguaugucaaguacgacggagaucccugggcggacuccgaugcccuggcuuucucuggcgugauggugagcaugaaggaaccugggugguacuccuuuggcuucgagaucaaagacaagaaaugcgaugucccguguauuggaaucgaaaugguucacgacggcgggaaggagaccuggcauagcgccgccacagcuauuuauugccucaugggaucuggccagcugcuuugggauaccgugacagggguggacauggcccuguga

SEQ ID NO: 212405 - RNA, 1401 nt, Artificial Sequence
  derived and/or modified sequence opt5 from neuraminidase__InfluenzaB__AGX19077
augcugcccagcaccauccagacacucacgcuguuccuuaccuccggcggggugcugcucucucuguacgucagcgccucccuuucuuaucugcucuacagcgacauucugcugaaguuuacaccuaccgagaucacagcuccgaccaugccccucgauugcgccaacgcguccaauguucaagcugugaacagaucugccacaaaaggagugaccccucugcuucccgaaccugaguggacguauccccggcugagcuguccuggcuccaccuuccagaaggcccuccugauuagcccgcaccgcuuuggggaaacaaaaggaaauucugcuccccuuaucauuagagagccuuucaucgccugcggccccaacgaauguaagcauuuugcucugacccacuacgccgcgcagccugggggauauuacaauggcacacggggcgaccgcaacaaacucagacaucugaucuccgucaagcuggggaagauucccaccguggagaauagcaucuuccacauggccgcuuggucuggauccgccugccaugauggcaaagaguggacguauauugggguugacggaccggauaacaaugcucuccugaagaucaaauacggcgaagccuacacagacaccuaucacagcuacgcgaacaagauucuucggacacaggagucugccuguaauugcaucgggggaaacuguuaucugaugauuaccgauggcuccgcuagcggcguguccgaaugccgcuuucucaaaaucagagaggggcggaucauuaaggagaucuucccuaccggacgcgucaagcacacagaagaguguacgugcggcuuugccucuaauaaaaccauugaaugugcuugcagagacaacagcuacacagccaagcggcccuucgugaaacugaauguugagaccgauacagccgaaauccgccuuaugugcaccgacacguaucuggauacaccuagacccgacgauggguccauuaccggacccugugagagcaacggcgacaaggggucuggaggcaucaaaggcggguuugugcaucaacggauggcuuccaagaucggacgcugguacagcagaaccaugucuaaaacagagcggaugggcauggggcucuaugucaaguacgacggagauccuugggcggacagcgaugcccuggcuuucuccggcgugauggugucuaugaaggaaccggggugguacagcuuuggcuucgagauuaaagacaagaaaugcgauguccccuguaucggaauugaaaugguucacgacggcgggaaggagaccuggcauuccgccgccacagcuaucuauugccugaugggaagcggccagcuccugugggauacggugaccgggguggacauggcccuuuga

SEQ ID NO: 212406 - RNA, 1401 nt, Artificial Sequence
  derived and/or modified sequence opt5 from neuraminidase__InfluenzaB__AGX19088
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucgucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggguccggaggcauuaaaggcggguuuguccaucaacggauggcuagcaagaucggacgcugguacucuagaaccaugagcaaaaccgagcggaugggcauggggcuguaugugaaguacgacggagaucccugggcggacuccgaugcccuggcuuucucuggcgugauggucagcaugaaggaaccugggugguacuccuuuggcuucgagaucaaagacaagaaaugcgauguuccguguauuggaaucgaaauggugcacgacggcgggaaggagacauggcauagcgccgccaccgcuauuuauugccucaugggaucuggccagcugcuuugggauacagugacgggggucgacauggcccuguga

SEQ ID NO: 212407 - RNA, 1401 nt, Artificial Sequence; identical to SEQ ID NO: 211659
  derived and/or modified sequence opt5 from neuraminidase__InfluenzaB__AGX19099

SEQ ID NO: 212408 - RNA, 1401 nt, Artificial Sequence
  derived and/or modified sequence opt5 from neuraminidase__InfluenzaB__AGX19110
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauuaagcacaccgaagaguguacaugcggcuuugccagcaauaaaacgaucgaaugugcuugcagagacaacuccuacaccgccaagcggccuuucauuaaacuuaaugucgagacagauaccgccgaaauccgccugaugugcacagagaccuaucucgacacgcccagaccugaugacgggagcaucacaggacccugugagucuaacggcgauaagggguccggaggcauuaaaggcggguuugugcaucaacggauggcuagcaagaucggacgcugguacucuagaaccaugagcaaaaccgaacggaugggcauggggcuguauguuaaguacgacggagaccccugggcggauuccgacgcccugguguucucuggcgucauggugagcauggaggaaccugggugguacuccuuuggcuucgagauuaaggauaaaaagugcgacgugccguguaucggaauugaaaugguccacgauggcgggaaagagacauggcauagcgcugccaccgccaucuauugccucaugggaucuggccagcugcuuugggacacaguuacgggggugaacauggcucuguga

SEQ ID NO: 212409 - RNA, 1401 nt, Artificial Sequence
  derived and/or modified sequence opt5 from neuraminidase__InfluenzaB__AGX19121
augcugcccagcaccacacagacgcucacccuguuccuuacauccggcggggugcugcucucucuguacgucagcgccucccuuucuuaucugcucuacagcgacauccugcugaaguuuuccccuaccgagauuacagcuccgaccaugccccucgauugcgccaacgcgucuaauguucaagcugugaacagaagcgccacaaaaggagugacccugcuucugccugaacccgaguggacguauccucggcucuccugucccggcagcaccuuccagaaggcccugcuuaucucuccucaccgcuuuggggaaacaaaaggaaauuccgcuccgcugauuaucagagagcccuucauugccugcggcccuaacgaauguaagcauuuugcucucacccacuacgccgcgcagcccgggggauauuacaauggcacacggggcgaccgcaacaaacugagacaucugaucagcgucaagcucgggaagaucccuaccguggaaaauucuauuuuccacauggccgcuugguccggaagcgccugccaugauggcaaagaguggacguauaucgggguugacggacccgauaacaaugcucugcuuaagauuaaauacggcgaggccuacacagacaccuaucacucuuacgcgaacaagauccugcggacacaggaguccgccuguaauugcauugggggaaacuguuaucucaugaucaccgauggcagcgcuuccggcgugucugaaugccgcuuucugaaaauuagagaggggcggaucaucaaggagauuuucccgaccggacgcgucaagcacacagaagaguguacgugcggcuuugccagcaauaaaaccaucgaaugugcuugcagagacaacuccuacacagccaagcggccuuucgugaaacuuaauguugagaccgauacagccgaaauucgccugaugugcaccgacacguaucucgauacacccagaccugacgaugggagcaucaccggacccugugagucuaacggcgacaagggguccggaggcauuaaaggcggguuugugcaucaacggauggcuagcaagaucggacgcugguacucuagaaccaugagcaaaacagagcggaugggcauggggcuguaugucaaguacgacggagaucccugggcggacuccgaugcccuggcuuucagaggcgugauggugucuaugaaggaaccugggugguacagcuuuggcuucgagaucaaagacaagaaaugcgaugucccguguauuggaaucgaaaugguucacgacggcgggaaggagaccuggcauuccgccgccacagcuauuuauugccucaugggaagcggccagcugcuuugggauacggugaccgggguggacauggcccuguga

SEQ ID NO: 212410 - RNA, 1401 nt, Artificial Sequence; identical to SEQ ID NO: 212293
  derived and/or modified sequence opt5 from neuraminidase__InfluenzaB__AGX19132

SEQ ID NO: 212411 - RNA, 1401 nt, Artificial Sequence; identical to SEQ ID NO: 212397
  derived and/or modified sequence opt5 from neuraminidase__InfluenzaB__AGX19143

SEQ ID NO: 212412 - RNA, 1401 nt, Artificial Sequence
  derived and/or modified sequence opt5 from neuraminidase__InfluenzaB__AGX19154
augcugcccagcaccauccagacacucacgcuguuccuuaccuccggcggggugcugcucucucuguacgucagcgccucccuuucuuaucugcucuacagcaacauucugcugaaguuuuccccuacagagaucaccgcuccgacaaugccccucgacugcgccaaugcgucuaacguucacgcugugaauagaagcgccaccaaaggagugacacugcuucugccugaacccgaguggaccuauccucggcucuccugucccggcagcacguuccaaaaggcccugcuuauuucuccucaucgcuuuggggaaaccaaaggaaacuccgcuccgcugaucauuagagagcccuucaucgccugcggcccuaaugaauguaagcacuuugcucucacacauuacgccgcgcagcccgggggauauuacaacggcacccggggcgaucgcaauaaacugagacaccugaucagcgucaagcucgggaagauuccuacaguggagaacucuaucuuccauauggccgcuugguccggaagcgccugccacgacggcaaagaguggaccuauauugggguugauggacccgacaauaacgcucugcuuaagaucaaauacggcgaagccuacacggauacauaucacucuuacgcgaauaacauucugcggacccaggaguccgccuguaauugcaucgggggaaacuguuaucucaugauuacagacggcagcgcuuccggcgugucugaaugccgcuuucugaagaucagagaggggcggaucauuaaagagaucuucccgaccggacgcgucaagcauaccgaagaguguacaugcggcuuugccagcaauaagacgauugaaugugcuugcagagauaacuccuacaccgccaaacggccuuucgugaaacuuaacguugagacagacaccgccgaaauccgccugaugugcacagauaccuaucucgacacgcccagaccugaugacgggagcauuacaggacccugugagucuaauggcgauaagggguccggaggcaucaagggcggguuugugcaccagcggauggcuagcaaaaucggacgcugguacucuagaaccaugagcaagaccgagcggaugggcauggggcuguaugucaaauacgacggagaccccugggcggauuccgacgcccuggcuuucucuggcgugauggugagcaugaaggaaccugggugguacuccuuuggcuucgagauuaaggauaaaaagugcgacgucccguguaucggaauugaaaugguucaugauggcgggaaagagacauggcacagcgccgccaccgcuaucuauugccucaugggaucuggccaacugcuuugggacacagugacggggguggauauggcccuguga

SEQ ID NO: 212413 - RNA, 1401 nt, Artificial Sequence; identical to SEQ ID NO: 211659
  derived and/or modified sequence opt5 from neuraminidase__InfluenzaB__AGX19165

SEQ ID NO: 212414 - RNA, 1401 nt, Artificial Sequence
  derived and/or modified sequence opt5 from neuraminidase__InfluenzaB__AGX19176
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaaucggacccgcggcgacagaaacaaacugcggcaccugaucagcgucaagcucggcaagauuccuacaguggaaaauucuaucuuccauauggccgcuugguccgggagcgccugccacgauggaaaagaguggaccuauauuggcguugacgggcccgauaacaaugcucugcuuaagaucaaauacggagaggccuacacggacacauaucacucuuacgcgaacaauauucugcgcacccaggaguccgccuguaacugcaucggcgggaauuguuaucucaugauuacagauggaagcgcuuccggcgugucugaaugcagauuucugaagauccgggagggccgcaucauuaaagagaucuucccgaccgggagagucaagcauaccgaagaguguacaugcggauuugccagcaacaagacgauugaaugugcuugccgggacaauuccuacaccgccaaacgcccuuucgugaaacuuaacguugagacagauaccgccgaaaucagacugaugugcacagacaccuaucucgauacgccccggccugacgauggcagcauuacagggcccugugagucuaacggagacaagggcuccgggggaaucaagggcggcuuugugcaccagcgcauggcuagcaaaaucgggagaugguacucucggaccaugagcaagaccgagagaaugggaaugggccuguaugucaaauacgacggggaucccugggcggacuccgaugcccuggcuuucucuggagugauggugagcaugaaggaaccuggcugguacuccuuuggguucgagauuaaggacaaaaagugcgaugucccguguaucggcauugaaaugguucaugacggaggcaaagagacauggcacagcgccgccaccgcuaucuauugccucauggggucuggacaacugcuuugggauacagugacgggcguggacauggcccuguga

SEQ ID NO: 212415 - RNA, 1401 nt, Artificial Sequence
  derived and/or modified sequence opt5 from neuraminidase__InfluenzaB__AGX19187
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccuguagcggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgaacaagauucugcggacccaggagagcgccuguaauugcaucgggggaaacuguuaucucaugauuacagauggcuccgcuucuggcgugagcgaaugccgcuuucugaaaaucagagaggggcggaucauuaaggagaucuuccccaccggacgcgucaagcacaccgaagaguguacaugcggcuuugccuccaauaaaacgauugaaugugcuugcagagacaacagcuacaccgccaagcggccguucgugaaacuuaauguugagacagauaccgccgaaauccgccugaugugcacagacaccuaucucgauacgccuagacccgacgaugggucuauuacaggaccuugugaguccaacggcgacaaggggagcggaggcaucaaaggcggguuugugcaucaacggauggcuucuaagaucggacgcugguacagcagaaccauguccaaaaccgagcggaugggcauggggcuguaugucaaguacgacggagaucccugggcggacucugaugcccuggcuuucagcggcgugaugguguccaugaaggaacccgggugguacagcuuuggcuucgagauuaaagacaagaaaugcgaugucccuuguaucggaauugaaaugguucacgacggcgggaaggagacauggcauucugccgccaccgcuaucuauugccucaugggauccggccagcugcuuugggauacagugacggggguggacauggcccuguga

SEQ ID NO: 212416 - RNA, 1401 nt, Artificial Sequence
  derived and/or modified sequence opt5 from neuraminidase__InfluenzaB__AGX19198
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauuaugccaacgcgucuaauguucaagcugugaacagaagcgccaccaaaggagugacacugcuucugccugaacccgaguggaccuacccucggcucuccugccccggcagcacguuccagaaggcccugcuuauuucuccucaccgcuuuggggaaaccaaaggaaauuccgcuccgcugaucauuagagagcccuucaucgccuguggcccuaacgaaugcaagcauuuugcucucacacacuaugccgcgcagcccgggggauacuauaauggcacccggggcgaccgcaacaaacugagacaucugaucagcgucaagcucgggaagauuccuacaguggaaaauucuaucuuccacauggccgcuugguccggaagcgccugucaugauggcaaagaguggaccuacauugggguugacggacccgauaacaaugcucugcuuaagaucaaauacggcgaggccuauacggacacauaccacucuuaugcgaacaagauucugcggacccaggaguccgccugcaauuguaucgggggaaacugcuaccucaugauuacagauggcagcgcuuccggcgugucugaaugucgcuuucugaaaaucagagaggggcggaucauuaaggagaucuucccgaccggacgcgucaagcacaccgaagagugcacauguggcuuugccagcaauaaaacgauugaaugcgcuuguagagacaacuccuauaccgccaagcggccuuucgugaaacuuaauguugagacagauaccgccgaaauccgccugaugugcacagacaccuaccucgauacgcccagaccugacgaugggagcauuacaggacccugcgagucuaacggcgacaagggguccggaggcaucaaaggcggguuugugcaucaacggauggcuagcaagaucggacgcugguauucuagaaccaugagcaaaaccgagcggaugggcauggggcuguacgucaaguacgacggagaucccugggcggacuccgaugcccuggcuuucucuggcgugauggugagcaugaaggaaccugggugguauuccuuuggcuucgagauuaaagacaagaaaugugaugucccgugcaucggaauugaaaugguucacgacggcgggaaggagacauggcauagcgccgccaccgcuaucuacugucucaugggaucuggccagcugcuuugggauacagugacggggguggacauggcccuguga

SEQ ID NO: 212417 - RNA, 1401 nt, Artificial Sequence; identical to SEQ ID NO: 212397
  derived and/or modified sequence opt5 from neuraminidase__InfluenzaB__AGX19209

SEQ ID NO: 212418 - RNA, 1401 nt, Artificial Sequence
  derived and/or modified sequence opt5 from neuraminidase__InfluenzaB__AGX19220
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaagaucaaauacggcgaggccuacacggacacauaucacuccuacgcgaacaagauucugcggacccaggagagcgccuguaauugcaucgggggaaacuguuaucucaugauuacagauggcuccgcuucuggcgugagcgaaugccgcuuucugaaaaucagagaggggcggaucauuaaggagaucuuccccaccggacgcgucaagcacaccgaagaguguacaugcggcuuugccuccaauaaaacgauugaaugugcuugcagagacaacagcuacaccgccaagcggccguucgugaaacuuaauguugagacagauaccgccgaaauccgccugaugugcacagacaccuaucucgauacgccuagacccgacgaugggucuauuacaggaccuugugaguccaacggcgaccgggggagcggaggcaucaagggcggguuugugcaucaacgcauggcuucuaaaaucggaagaugguacagccggaccauguccaagaccgagagaaugggcauggggcuguaugucaaauacgacggagaucccugggcggacucugaugcccuggcuuucagcggcgugaugguguccaugaaggaacccgggugguacagcuuuggcuucgagauuaaggacaaaaagugcgaugucccuuguaucggaauugaaaugguucacgacggcgggaaagagacauggcauucugccgccaccgcuaucuauugccucaugggauccggccagcugcuuugggauacagugacggggguggacauggcccuguga

SEQ ID NO: 212419 - RNA, 1401 nt, Artificial Sequence; identical to SEQ ID NO: 211865
  derived and/or modified sequence opt5 from neuraminidase__InfluenzaB__AGX19231

SEQ ID NO: 212420 - RNA, 1401 nt, Artificial Sequence
  derived and/or modified sequence opt5 from neuraminidase__InfluenzaB__AGX19253
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaacgaauguaagcacuuugcucucacacauuacgccgcgcagcccgggggauauuacaauggcaccagaggcgaccggaacaaacugcgccaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaagauucugagaacccaggaguccgccuguaauugcaucgggggaaacuguuaucucaugauuacagauggcagcgcuuccggcgugucugaaugccgguuucugaaaauccgcgaggggagaaucauuaaggagaucuucccgaccggacgggucaagcauaccgaagaguguacaugcggcuuugccagcaauaaaacgauugaaugugcuugccgcgacaacuccuacaccgccaagagaccuuucgugaaacuuaauguugagacagauaccgccgaaauccggcugaugugcacagacaccuaucucgauacgccccgcccugacgaugggagcauuacaggacccugugagucuaacggcgacaagggguccggaggcaucaaaggcggguuugugcaccaaagaauggcuagcaagaucggacggugguacucucgcaccaugagcaaaaccgagagaaugggcauggggcuguaugucaaguacgacggagaucccugggcggacuccgauucucuggccuucagcggcgugaugguguccaugaaggaaccugggugguacagcuuuggcuucgagauuaaagacaagaaaugcgaugucccguguaucggaauugaaaugguucaugacggcgggaaggagacauggcacucugcugccaccgccaucuauugccucaugggauccggccagcugcuuugggauacagugacggggguggacauggcucuguga

SEQ ID NO: 212421 - RNA, 1401 nt, Artificial Sequence; identical to SEQ ID NO: 212395
  derived and/or modified sequence opt5 from neuraminidase__InfluenzaB__AGX19264

SEQ ID NO: 212422 - RNA, 1401 nt, Artificial Sequence; identical to SEQ ID NO: 211659
  derived and/or modified sequence opt5 from neuraminidase__InfluenzaB__AGX19275

SEQ ID NO: 212423 - RNA, 1401 nt, Artificial Sequence
  derived and/or modified sequence opt5 from neuraminidase__InfluenzaB__AGX19286
augauccccagcaccauucagacacugacccucuuccugacguccggcggggugcuucugucucucuacgucagcgccucccugucuuaucuucuguacagcgacauccuccugaaguuuuccccuacagagauuaucgcuccgaccaugccccuggauugcgccaacgcgucuaauguucacgcugugaacagaagcgccacaaaaggagugacccuccugcuuccugaacccgaguggacauauccucggcuguccugucccggcagcaccuuccaaaaggcccuccugauuucuccucaucgcuuuggggaaacgaaaggaaauuccgcuccgcuuaucaucagagagcccuucauugccugcggcccuaacgaauguaagcacuuugcucugacccauuacgccgcgcagcccgggggauauuacaauggcacacggggcgaccgcaacaaacucagacaccugaucagcgucaagcuggggaagauuccuaccguggaaaauucuaucuuccauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugaucaccgauggcagcgcuuccggcgugucugaaugccgcuuucucaagauuagagaggggcggaucauuaaagagaucuucccgacaggacgcgucaagcauaccgaagaguguaccugcggcuuugccagcaacaagacaauugaaugugcuugcagagacaauuccuacacggccaaacggccuuucgugaagcugaacguugagaccgauacagccgaaauccgccuuaugugcaccgacacauaucuggauacccccagaccugacgaugggagcaucacgggacccugugagucuaacggcgacaaaggguccggaggcauuaagggcggguuugugcaccagcggauggcuagcaaaaucggacgcugguacucuagaacaaugagcaagaccgagcggaugggcauggggcucuaugucaaauacgacggagaucccugggcggacuccgaugcccuggcuuucucuggcgugauggugagcaugaaggaaccugggugguacuccuuuggcuucgagauuaaggacaaaaagugcgaugucccguguaucggaauugaaaugguucaugacggcgggaaagagaccuggcacagcgccgccacagcuaucuauugccugaugggaucuggccaacuccugugggauaccgugacagggguggacauggcccuuuga

SEQ ID NO: 212424 - RNA, 1401 nt, Artificial Sequence
  derived and/or modified sequence opt5 from neuraminidase__InfluenzaB__AGX19297
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucacgcugugaacagaagcgccacaaaaggagugacccugcuucugccugaacccgaguggacauauccucggcucuccugucccggcagcaccuuccaaaaggcccugcuuaucucuccucaucgcuuuggggaaacgaaaggaaauuccgcuccgcugauuaucagagagcccuucaucgccugcggcccuaacgaauguaagcacuuugcucucacccauuacgccgcgcagcccgggggauauuacaauggcacacggggcgaccgcaacaaacugagacaccugauuagcgucaagcucgggaagaucccuaccguggaaaauucuauuuuccauauggccgcuugguccggaagcgccugccacgauggcaaagaguggacauauaucgggguugacggacccgauaacaaugcucugcuuaagauuaaauacggcgaggccuacaccgacacguaucacucuuacgcgaacaauauccugcggacacaggaguccgccuguaacugcauugggggaaauuguuaucucaugaucaccgauggcagcgcuuccggcgugucugaaugccgcuuucugaagaucagagaggggcggauuaucaaagagauuuucccgacaggacgcgucaagcauaccgaagaguguaccugcggcuuugccagcaacaagacaaucgaaugugcuugcagagacaauuccuacacggccaaacggccuuucgugaaacuuaacguugagaccgauacagccgaaauucgccugaugugcaccgacacauaucucgauacccccagaccugacgaugggagcaucacgggacccugugagucuaacggcgacaagggguccggaggcaucaagggcggguuugugcaccagcggauggcuagcaaaauuggacgcugguacucuagaacaaugagcaagaccgagcggaugggcauggggcuguaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucaugacggcgggaaagagaccuggcacagcgccgccacagcuauuuauugccucaugggaucuggccaacugcuuugggauaccgugacagggguggacauggcccuguga

SEQ ID NO: 212425 - RNA, 1401 nt, Artificial Sequence; identical to SEQ ID NO: 212424
  derived and/or modified sequence opt5 from neuraminidase__InfluenzaB__AGX19308

SEQ ID NO: 212426 - RNA, 1401 nt, Artificial Sequence; identical to SEQ ID NO: 212424
  derived and/or modified sequence opt5 from neuraminidase__InfluenzaB__AGX19319

SEQ ID NO: 212427 - RNA, 1401 nt, Artificial Sequence
  derived and/or modified sequence opt5 from neuraminidase__InfluenzaB__AGX19330
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucacgcugugaacagaagcgccacaaaaggagugacccugcuucugccugaacccgaguggacauauccucggcucuccugucccggcagcaccuuccaaaaggcccugcuuaucucuccucaucgcuuuggggaaacgaaaggaaauuccgcuccgcugauuaucagagagcccuucaucgccugcggcccuaacgaauguaagcacuuugcucucacccauuacgccgcgcagcccgggggauauuacaauggcacacggggcaaccgcaauaaacugagacaccugauuagcgucaagcucgggaagaucccuaccguggagaacucuauuuuccauauggccgcuugguccggaagcgccugccacgacggcaaagaguggacauauaucgggguugauggacccgacaauaacgcucugcuuaagauuaaauacggcgaagccuacaccgauacguaucacucuuacgcgaauaacauccugcggacacaggaguccgccuguaauugcauugggggaaacuguuaucucaugaucaccgacggcagcgcuuccggcgugucugaaugccgcuuucugaagaucagagaggggcggauuaucaaagagauuuucccgacaggacgcgucaagcauaccgaagaguguaccugcggcuuugccagcaauaagacaaucgaaugugcuugcagagauaacuccuacacggccaaacggccuuucgugaaacuuaacguugagaccgacacagccgaaauucgccugaugugcaccgauacauaucucgacacccccagaccugaugacgggagcaucacgggacccugugagucuaauggcgauaagggguccggaggcaucaagggcggguuugugcaccagcggauggcuagcaaaauuggacgcugguacucuagaacaaugagcaagaccgagcggaugggcauggggcuguaugucaaauacgacggagaccccugggcggauuccgacgcccuggcuuucucuggcgugauggugagcaugaaggaaccugggugguacuccuuuggcuucgagaucaaggauaaaaagugcgacgucccguguauuggaaucgaaaugguucaugauggcgggaaagagaccuggcacagcgccgccacagcuauuuauugccucaugggaucuggccaacugcuuugggacaccgugacagggguggauauggcccuguga

SEQ ID NO: 212428 - RNA, 1401 nt, Artificial Sequence; identical to SEQ ID NO: 212424
  derived and/or modified sequence opt5 from neuraminidase__InfluenzaB__AGX19341

SEQ ID NO: 212429 - RNA, 1401 nt, Artificial Sequence; identical to SEQ ID NO: 212424
  derived and/or modified sequence opt5 from neuraminidase__InfluenzaB__AGX19352

SEQ ID NO: 212430 - RNA, 1401 nt, Artificial Sequence
  derived and/or modified sequence opt5 from neuraminidase__InfluenzaB__AGX19363
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucacgcugugaacagaagcgccacaaaaggagugacccugcuucugccugaacccgaguggacauauccucggcucuccugucccggcagcaccuuccaaaaggcccugcuuaucucuccucaucgcuuuggggaaacgaaaggaaauuccgcuccgcugauuaucagagagcccuucaucgccugcggcccuaacgaauguaagcacuuugcucucaccuacuaugccgcgcagcccgggggauacuauaauggcacacggggcgaccgcaacaaacugagacaucugauuagcgucaagcucgggaagaucccuaccguggaaaauucuauuuuccacauggccgcuugguccggaagcgccugccaugauggcaaagaguggacauacaucgggguugacggacccgauaacaaugcucugcuuaagauuaaauacggcgaggccuauaccgacacguaccacucuuaugcgaacaauauccugcggacacaggaguccgccuguaacugcauugggggaaauuguuaccucaugaucaccgauggcagcgcuuccggcgugucugaaugccgcuuucugaagaucagagaggggcggauuaucaaagagauuuucccgacaggacgcgucaagcacaccgaagaguguaccugcggcuuugccagcaacaagacaaucgaaugugcuugcagagacaauuccuauacggccaaacggccuuucgugaaacuuaacguugagaccgauacagccgaaauucgccugaugugcaccgacacauaccucgauacccccagaccugacgaugggagcaucacgggacccugugagucuaacggcgacaagggguccggaggcaucaagggcggguuugugcaucagcggauggcuagcaaaauuggacgcugguauucuagaacaaugagcaagaccgagcggaugggcauggggcuguacgucaaauacgacggagaucccugggcggacuccgaugcccuggcuuucucuggcgugauggugagcaugaaggaaccugggugguauuccuuuggcuucgagaucaaggacaaaaagugcgaugucccguguauuggaaucgaaaugguucacgacggcgggaaagagaccuggcauagcgccgccacagcuauuuacugccucaugggaucuggccaacugcuuugggauaccgugacagggguggacauggcccuguga

SEQ ID NO: 212431 - RNA, 1401 nt, Artificial Sequence
  derived and/or modified sequence opt5 from neuraminidase__InfluenzaB__AGX19374
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucuguccgaacccgaguggaccuauccucggcucagcugucccggcucuacauuccagaaggcucugcuuaucuccccucaccgcuuuggggaaaccaaaggaaauagcgcuccccugauuaucagagagccuuucaucgccugcggcccgacggaauguaagcauuuugcccucacccacuacgcggcccagcccgggggauauuacaacggcacacgggaggaccgcaauaaacugagacaucugauuucugucaagcucggcaagaucccuaccguggagaacuccauuuuccacauggcugccuggagcgggucugcuugccaugauggaaaagaauggacauauaucggcguugacgggcccgauuccaaugcccugcuuaagauuaaauacggagaggcguacaccgacacguaucacagcuacgccaagaacauccugcggacacaagaauccgcuuguaauugcauuggcggggauuguuaucucaugaucaccgacggaccugccucuggcgugagcgagugccgcuuucugaaaaucagagagggccggauuaucaaggaaauuuuccccacagggcgcgucaagcacaccgaggaauguaccugcggauuugcuuccaacaaaacaaucgagugugccugcagagauaauagcuacacggccaagcggccguucgugaaacuuaacguugaaaccgacacagcugagauucgccugaugugcaccgagacauaucucgauaccccuagacccaaugacggcucuaucacggggccuugugaauccgauggagacaagggcagcgggggaaucaaaggcggcuuugugcaucagcggauggcgucuaagauugggcgcugguacagcagaacaauguccaaaaccaagcggaugggaaugggccuguaugucaaguacgacggggaucccuggaccgacucugaggcccuggcucucagcggagugaugguguccauggaggaacccggcugguacagcuucggguuugaaaucaaagauaagaaaugcgacgucccuuguauuggcaucgagaugguucacgauggaggcaagacaaccuggcauucugccgccacagcuauuuauugccugaugggguccggacagcuucugugggacacggugaccggcguggauauggcccucuga

SEQ ID NO: 212432 - RNA, 1401 nt, Artificial Sequence; identical to SEQ ID NO: 212424
  derived and/or modified sequence opt5 from neuraminidase__InfluenzaB__AGX19385

SEQ ID NO: 212433 - RNA, 1401 nt, Artificial Sequence
  derived and/or modified sequence opt5 from neuraminidase__InfluenzaB__AGX19396
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccaugccccucgauugcgccaacgcgucuaauguucacgcugugaacagaagcgccacaaaaggagugacccugcuucugccugaacccgaguggacauauccucggcucuccugucccggcagcaccuuccaaaaggcccugcuuaucucuccucaucgcuuuggggaaacgaaaggaaauuccgcuccgcugauuaucagagagcccuucaucgccugcggcccuaacgaauguaagcacuuugcucucacccauuacgccgcgcagcccgggggauauuacaauggcccucggggcgaccgcaacaaacugagacaccugauuagcgucaagcucgggaagauccccacaguggaaaauucuauuuuccauauggccgcuugguccggaagcgccugccacgauggcaaagaguggaccuauaucgggguugacggaccggauaacaaugcucugcuuaagauuaaauacggcgaggccuacacagacaccuaucacucuuacgcgaacaauauccugcggacgcaggaguccgccuguaacugcauugggggaaauuguuaucucaugaucacagauggcagcgcuuccggcgugucugaaugccgcuuucugaagaucagagaggggcggauuaucaaagagauuuucccuaccggacgcgucaagcauacagaagaguguaccugcggcuuugccagcaacaagaccaucgaaugugcuugcagagacaauuccuacacagccaaacggcccuucgugaaacuuaacguugagacggauaccgccgaaauucgccugaugugcacagacaccuaucucgauacaccuagacccgacgaugggagcaucaccggacccugugagucuaacggcgacaagggguccggaggcaucaagggcggguuugugcaccagcggauggcuagcaaaauuggacgcugguacucuagaacgaugagcaagacagagcggaugggcauggggcuguaugucaaauacgacggagauccuugggcggacuccgaugcccuggcuuucucuggcgugauggugagcaugaaggaaccggggugguacuccuuuggcuucgagaucaaggacaaaaagugcgauguccccuguauuggaaucgaaaugguucaugacggcgggaaagagaccuggcacagcgccgccaccgcuauuuauugccucaugggaucuggccaacugcuuugggauacagugaccgggguggacauggcccuguga

SEQ ID NO: 212434 - RNA, 1401 nt, Artificial Sequence; identical to SEQ ID NO: 212424
  derived and/or modified sequence opt5 from neuraminidase__InfluenzaB__AGX19407

SEQ ID NO: 212435 - RNA, 1401 nt, Artificial Sequence; identical to SEQ ID NO: 211985
  derived and/or modified sequence opt5 from neuraminidase__InfluenzaB__AGX19418

SEQ ID NO: 212436 - RNA, 1401 nt, Artificial Sequence
  derived and/or modified sequence opt5 from neuraminidase__InfluenzaB__AGX19429
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaacccggagaaugggaaugggccuguaugugaaguacgacggggaucccuggaccgacuccgaggcccuggcucucucuggagucauggugagcauggaggaaccuggcugguacuccuucggguuugaaauuaaggauaaaaagugcgacgugccguguaucggcauugagaugguccacgauggaggcaaaacaaccuggcauagcgccgccacagcuaucuauugccugauggggucuggacagcuucugugggacacgguuaccggcguggauauggcccucuga

SEQ ID NO: 212437 - RNA, 1401 nt, Artificial Sequence
  derived and/or modified sequence opt5 from neuraminidase__InfluenzaB__AGX19451
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaaccauagcgccaccaaaggagugacacugcuucugccugaacccgaguggaccuauccuagacucuccugucccggcagcacguuccaaaaggcccugcuuauuucuccucaccgguuuggggaaaccaaaggaaauuccgcuccgcugaucauucgcgagcccuucaucgccugcggcccuaacgaauguaagcauuuugcucucacacacuacgccgcgcagcccgggggauauuacaauggcaccagaggcgaccggaacaaacugcgccaucugaucagcgucaagcucgggaagauuccuacaguggaaaauucuaucuuccacauggccgcuugguccggaagcgccugccacgauggcaaagaguggaccuauauugggguugacggacccgauaacaaugcucugcuuaagaucaaauacggcgaggccuacacggacacauaucauucuuacgcgaacaauauucugagaacccaggaguccgccuguaacugcaucgggggaaauuguuaucucauggugacagauggcagcgcuuccggcgucucugaaugccgguuucugaagauucgcgaggggagaaucaucaaagagauuuucccgaccggacgggugaagcacaccgaagaguguacaugcggcuuugccagcaacaagacgaucgaaugugcuugccgcgacaauuccuacaccgccaaaagaccuuucguuaaacuuaacguggagacagauaccgccgaaauucggcugaugugcacagacaccuaucucgauacgccccgcccugacgaugggagcaucacaggacccugugagucuaacggcgacaagggguccggaggcauuaagggcggguuuguccaucagagaauggcuagcaaaaucggacggugguacucucgcaccaugagcaagaccgagagaaugggcauggggcuguaugugaaauacgacggagaucccugggcggacuccgaugcccuggcuuucucuggcgugauggucagcaugaaggaaccugggugguacuccuuuggcuucgagaucaaggacaaaaagugcgauguuccguguauuggaaucgaaauggugcacgacggcgggaaagagacauggcacagcgccgccaccgcuauuuauugccucaugggaucuggccaacugcuuugggauacagugacgggggucgacauggcccuguga

SEQ ID NO: 212438 - RNA, 1401 nt, Artificial Sequence; identical to SEQ ID NO: 212436
  derived and/or modified sequence opt5 from neuraminidase__InfluenzaB__AGX19462

SEQ ID NO: 212439 - RNA, 1401 nt, Artificial Sequence; identical to SEQ ID NO: 212436
  derived and/or modified sequence opt5 from neuraminidase__InfluenzaB__AGX19473

SEQ ID NO: 212440 - RNA, 1401 nt, Artificial Sequence; identical to SEQ ID NO: 211985
  derived and/or modified sequence opt5 from neuraminidase__InfluenzaB__AGX19484

SEQ ID NO: 212441 - RNA, 1401 nt, Artificial Sequence; identical to SEQ ID NO: 212437
  derived and/or modified sequence opt5 from neuraminidase__InfluenzaB__AGX19495

SEQ ID NO: 212442 - RNA, 1401 nt, Artificial Sequence; identical to SEQ ID NO: 211985
  derived and/or modified sequence opt5 from neuraminidase__InfluenzaB__AGX19506

SEQ ID NO: 212443 - RNA, 1401 nt, Artificial Sequence; identical to SEQ ID NO: 211985
  derived and/or modified sequence opt5 from neuraminidase__InfluenzaB__AGX19517

SEQ ID NO: 212444 - RNA, 1401 nt, Artificial Sequence; identical to SEQ ID NO: 211985
  derived and/or modified sequence opt5 from neuraminidase__InfluenzaB__AGX19528

SEQ ID NO: 212445 - RNA, 1401 nt, Artificial Sequence; identical to SEQ ID NO: 212437
  derived and/or modified sequence opt5 from neuraminidase__InfluenzaB__AGX19539

SEQ ID NO: 212446 - RNA, 1401 nt, Artificial Sequence
  derived and/or modified sequence opt5 from neuraminidase__InfluenzaB__AGX19550
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaaccauagcgccaccaaaggagugacacugcuucugccugaacccgaguggaccuauccuagacucuccugucccggcagcacguuccaaaaggcccugcuuauuucuccucaccgguuuggggaaaccaaaggaaauuccgcuccgcugaucauucgcgagcccuucaucgccugcggcccuaacgaauguaagcauuuugcucucacacacuacgccgcgcagcccgggggauauuacaauggcaccagaggcgaccggaacaaacugcgccaucugaucagcgucaagcucgggaagauuccuacaguggaaaauucuaucuuccacauggccgcuugguccggaagcgccugccacgauggcaaagaguggaccuauauugggguugacggacccgauaacaaugcucugcuuaagaucaaauacggcgaggccuacacggacacauaucauucuuacgcgaacaauauucugagaacccaggaguccgccuguaacugcaucgggggaaauuguuaucucauggugacagauggcagcgcuuccggcgucucugaaugccgguuucugaagauucgcgaggggagaaucaucaaagagauuuucccgaccggacgggugaagcacaccgaagaguguacaugcggcuuugccagcaacaagacgaucgaaugugcuugccgcgacaauuccuacaccgccaaaagaccuuucguuaaacuuaacguggagacagauaccgccgaaauucggcugaugugcacagacaccuaucucgauacgccccgcccugacgaugggagcaucacaggacccugugagucuaacggcgacaagggguccggaggcauuaagggcggguuuguccaucagagaauggcuagcaaaaucggacggugguacucucgcaccaugagcaagaccgagagaaugggcauggggcuguaugugaaauacgacggagaucccugggcggacuccgaugcccuggcuuucucuggcgugauggucagcaugaaugaaccugggugguacuccuuuggcuucgagaucaaggacaagaaaugcgauguuccguguauuggaaucgaaauggugcacgacggcgggaaggagacauggcacagcgccgccaccgcuauuuauugccucaugggaucuggccaacugcuuugggauacagugacgggggucgacauggcccuguga

SEQ ID NO: 212447 - RNA, 1401 nt, Artificial Sequence
  derived and/or modified sequence opt5 from neuraminidase__InfluenzaB__AGX19561
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaaccauagcgccaccaaaggagugacacugcuucugccugaacccgaguggaccuauccuagacucuccugucccggcagcacguuccaaaaggcccugcuuauuucuccucaccgguuuggggaaaccaaaggaaauuccgcuccgcugaucauucgcgagcccuucaucgccugcggcccuaacgaauguaagcauuuugcucucacacacuacgccgcgcagcccagaggguauuacaauggaacccggggcgaccgcaacaaacugagacaucugaucagcgucaagcucggcaagauuccuacaguggaaaauucuaucuuccacauggccgcuugguccgggagcgccugccacgauggaaaagaguggaccuauauuggcguugacgggcccgauaacaaugcucugcuuaagaucaaauacggagaggccuacacggacacauaucauucuuacgcgaacaauauucugcggacccaggaguccgccuguaacugcaucggcgggaauuguuaucucauggugacagauggaagcgcuuccggcgucucugaaugccgcuuucugaagauuagagagggccggaucaucaaagagauuuucccgaccgggcgcgugaagcacaccgaagaguguacaugcggauuugccagcaacaagacgaucgaaugugcuugcagagacaauuccuacaccgccaaacggccuuucguuaaacuuaacguggagacagauaccgccgaaauucgccugaugugcacagacaccuaucucgauacgcccagaccugacgauggcagcaucacagggcccugugagucuaacggagacaagggcuccgggggaauuaagggcggcuuuguccaucagcggauggcuagcaaaaucgggcgcugguacucuagaaccaugagcaagaccgagcggaugggaaugggccuguaugugaaauacgacggggaucccugggcggacuccgaugcccuggcuuucucuggagugauggucagcaugaaggaaccuggcugguacuccuuuggguucgagaucaaggacaaaaagugcgauguuccguguauuggcaucgaaauggugcacgacggaggcaaagagacauggcacagcgccgccaccgcuauuuauugccucauggggucuggacaacugcuuugggauacagugacgggcgucgacauggcccuguga

SEQ ID NO: 212448 - RNA, 1401 nt, Artificial Sequence
  derived and/or modified sequence opt5 from neuraminidase__InfluenzaB__AGX19572
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcuggccuucucuggcgugauggucagcaugaaggagccugggugguacuccuuuggcuucgaaaucaaagauaagaaaugcgacguuccguguauuggaaucgagauggugcacgauggcgggaaggaaacauggcauagcgcugccaccgccauuuauugccucaugggaucuggccagcugcuuugggacacagugacgggggucaauauggcucuguga

SEQ ID NO: 212449 - RNA, 1401 nt, Artificial Sequence; identical to SEQ ID NO: 211985
  derived and/or modified sequence opt5 from neuraminidase__InfluenzaB__AGX19583

SEQ ID NO: 212450 - RNA, 1401 nt, Artificial Sequence; identical to SEQ ID NO: 211985
  derived and/or modified sequence opt5 from neuraminidase__InfluenzaB__AGX19594

SEQ ID NO: 212451 - RNA, 1401 nt, Artificial Sequence; identical to SEQ ID NO: 211985
  derived and/or modified sequence opt5 from neuraminidase__InfluenzaB__AGX19605

SEQ ID NO: 212452 - RNA, 1401 nt, Artificial Sequence; identical to SEQ ID NO: 211985
  derived and/or modified sequence opt5 from neuraminidase__InfluenzaB__AGX19616

SEQ ID NO: 212453 - RNA, 1401 nt, Artificial Sequence; identical to SEQ ID NO: 212437
  derived and/or modified sequence opt5 from neuraminidase__InfluenzaB__AGX19627

SEQ ID NO: 212454 - RNA, 1401 nt, Artificial Sequence; identical to SEQ ID NO: 211985
  derived and/or modified sequence opt5 from neuraminidase__InfluenzaB__AGX19638

SEQ ID NO: 212455 - RNA, 1401 nt, Artificial Sequence; identical to SEQ ID NO: 212437
  derived and/or modified sequence opt5 from neuraminidase__InfluenzaB__AGX19649

SEQ ID NO: 212456 - RNA, 1401 nt, Artificial Sequence; identical to SEQ ID NO: 212437
  derived and/or modified sequence opt5 from neuraminidase__InfluenzaB__AGX19660

SEQ ID NO: 212457 - RNA, 1401 nt, Artificial Sequence; identical to SEQ ID NO: 211985
  derived and/or modified sequence opt5 from neuraminidase__InfluenzaB__AGX19671

SEQ ID NO: 212458 - RNA, 1401 nt, Artificial Sequence; identical to SEQ ID NO: 211985
  derived and/or modified sequence opt5 from neuraminidase__InfluenzaB__AGX19682

SEQ ID NO: 212459 - RNA, 1401 nt, Artificial Sequence; identical to SEQ ID NO: 212437
  derived and/or modified sequence opt5 from neuraminidase__InfluenzaB__AGX19704

SEQ ID NO: 212460 - RNA, 1401 nt, Artificial Sequence
  derived and/or modified sequence opt5 from neuraminidase__InfluenzaB__AGX19715
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcaccacaaaaggagugacccugcuucugccugaacccgaguggacguauccucggcucuccugucccggcagcaccuuccaaaaggcccugcuuauuucuccucaucgcuuuggggaaacaaaaggaaauuccgccccgcugaucauuagagagcccuucaucgcuugcggcccuaacgaauguaagcacuuugcccucacccauuacgcugcccagcccgggggauauuacaauggcacacggggcgaccgcaacaaacugagacaccugaucagcgucaagcucgggaagauuccuaccguggaaaauucuaucuuccauauggcggccugguccggaagcgcuugccacgauggcaaagaguggacguauauugggguugacggacccgauaacaaugcccugcuuaagaucaaauacggcgaggcuuacacagacaccuaucacucuuacgccaacaauauucugcggacacaggaguccgcguguaacugcaucgggggaaauuguuaucucaugauuaccgauggcagcgccuccggcgugucugaaugccgcuuucugaagaucagagaggggcggaucauuaaagagaucuucccgaccggacgcgucaagcauacagaagaguguacgugcggcuuugcuagcaacaagaccauugaaugugccugcagagacaauuccuacacagcuaaacggccuuucgugaaacuuaacguugagaccgauacagccgaaauccgccugaugugcaccgacacguaucucgauacacccagaccugacgaugggagcauuaccggacccugugagucuaacggcgacaagggguccggaggcaucaagggcggguuugugcaccagcggauggccagcaaaaucggacgcugguacucuagaaccaugagcaagacagagcggaugggcauggggcuguaugucaaauacgacggagaucccugggcugacuccgaugcgcuggccuucucuggcgugauggugagcaugaaggaaccugggugguacuccuuuggcuucgagauuaaggacaaaaagugcgaugucccguguaucggaauugaaaugguucaugacggcgggaaagagaccuggcacagcgcugccacagccaucuauugccucaugggaucuggccaacugcuuugggauacggugaccgggguggacauggcucuguga

SEQ ID NO: 212461 - RNA, 1401 nt, Artificial Sequence; identical to SEQ ID NO: 211985
  derived and/or modified sequence opt5 from neuraminidase__InfluenzaB__AGX19726

SEQ ID NO: 212462 - RNA, 1401 nt, Artificial Sequence; identical to SEQ ID NO: 211985
  derived and/or modified sequence opt5 from neuraminidase__InfluenzaB__AGX19737

SEQ ID NO: 212463 - RNA, 1401 nt, Artificial Sequence; identical to SEQ ID NO: 211985
  derived and/or modified sequence opt5 from neuraminidase__InfluenzaB__AGX19748

SEQ ID NO: 212464 - RNA, 1401 nt, Artificial Sequence; identical to SEQ ID NO: 212437
  derived and/or modified sequence opt5 from neuraminidase__InfluenzaB__AGX19759

SEQ ID NO: 212465 - RNA, 1401 nt, Artificial Sequence; identical to SEQ ID NO: 211985
  derived and/or modified sequence opt5 from neuraminidase__InfluenzaB__AGX19770

SEQ ID NO: 212466 - RNA, 1401 nt, Artificial Sequence; identical to SEQ ID NO: 211985
  derived and/or modified sequence opt5 from neuraminidase__InfluenzaB__AGX19781

SEQ ID NO: 212467 - RNA, 1401 nt, Artificial Sequence; identical to SEQ ID NO: 211985
  derived and/or modified sequence opt5 from neuraminidase__InfluenzaB__AGX19792

SEQ ID NO: 212468 - RNA, 1401 nt, Artificial Sequence; identical to SEQ ID NO: 211985
  derived and/or modified sequence opt5 from neuraminidase__InfluenzaB__AGX19803

SEQ ID NO: 212469 - RNA, 1401 nt, Artificial Sequence; identical to SEQ ID NO: 211985
  derived and/or modified sequence opt5 from neuraminidase__InfluenzaB__AGX19814

SEQ ID NO: 212470 - RNA, 1401 nt, Artificial Sequence
  derived and/or modified sequence opt5 from neuraminidase__InfluenzaB__AGX19825
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaaccauagcgccaccaaaggagugacacugcuucugccugaacccgaguggaccuauccuagacucuccugucccggcagcacguuccaaaaggcccugcuuauuucuccucaccgguuuggggaaaccaaaggaaauuccgcuccgcugaucauucgcgagcccuucaucgccugcggcccuaacgaauguaagcauuuugcucucacacacuacgccgcgcagcccgggggauauuacaauggcaccagaggcgaccggaacaaacugcgccaucugaucagcgucaagcucgggaagauuccuacaguggaaaauucuaucuuccacauggccgcuugguccggaagcgccugccacgauggcaaagaguggaccuauauugggguugacggacccgauaacaaugcucugcuuaagaucaaauacggcgaggccuacacggacacauaucauucuuacgcgaacaauauucugagaacccaggaguccgccuguaacugcaucgggggaaauuguuaucucauggugacagauggcagcgcuuccggcgucucugaaugccgguuucugaagauucgcgaggggagaaucaucaaagagauuuucccgaccggacgggugaagcacaccgaagaguguacaugcggcuuugccaacaauaagacgaucgaaugugcuugccgcgacaacagcuacaccgccaaaagaccuuucguuaaacuuaacguggagacagauaccgccgaaauucggcugaugugcacagacaccuaucucgauacgccccgcccugacgauggguccaucacaggacccugugagagcaauggcgacaaggggucuggaggcauuaagggcggguuuguccaucagagaauggcuuccaaaaucggacggugguacagccgcaccaugucuaagaccgagagaaugggcauggggcuguaugugaaauacgacggagaucccugggcggacagcgaugcccuggcuuucuccggcgugauggucucuaugaaggaaccugggugguacagcuuuggcuucgagaucaaggacaaaaagugcgauguuccguguauuggaaucgaaauggugcacgacggcgggaaagagacauggcacuccgccgccaccgcuauuuauugccucaugggaagcggccaacugcuuugggauacagugacgggggucgacauggcccuguga

SEQ ID NO: 212471 - RNA, 1401 nt, Artificial Sequence; identical to SEQ ID NO: 211985
  derived and/or modified sequence opt5 from neuraminidase__InfluenzaB__AGX19836

SEQ ID NO: 212472 - RNA, 1401 nt, Artificial Sequence; identical to SEQ ID NO: 211985
  derived and/or modified sequence opt5 from neuraminidase__InfluenzaB__AGX19847

SEQ ID NO: 212473 - RNA, 1401 nt, Artificial Sequence; identical to SEQ ID NO: 211985
  derived and/or modified sequence opt5 from neuraminidase__InfluenzaB__AGX19858

SEQ ID NO: 212474 - RNA, 1401 nt, Artificial Sequence; identical to SEQ ID NO: 211985
  derived and/or modified sequence opt5 from neuraminidase__InfluenzaB__AGX19869

SEQ ID NO: 212475 - RNA, 1401 nt, Artificial Sequence; identical to SEQ ID NO: 211985
  derived and/or modified sequence opt5 from neuraminidase__InfluenzaB__AGX19880

SEQ ID NO: 212476 - RNA, 1401 nt, Artificial Sequence; identical to SEQ ID NO: 211985
  derived and/or modified sequence opt5 from neuraminidase__InfluenzaB__AGX19891

SEQ ID NO: 212477 - RNA, 1401 nt, Artificial Sequence; identical to SEQ ID NO: 211985
  derived and/or modified sequence opt5 from neuraminidase__InfluenzaB__AGX19902

SEQ ID NO: 212478 - RNA, 1401 nt, Artificial Sequence
  derived and/or modified sequence opt5 from neuraminidase__InfluenzaB__AGX19913
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcuaugaaccauagcgccaccaaaggagugacacugcuucugccugaacccgaguggaccuauccuagacucuccugucccggcagcacguuccaaaaggcccugcuuauuucuccucaccgguuuggggaaaccaaaggaaauuccgcuccgcugaucauucgcgagcccuucaucgccugcggcccuaacgaauguaagcauuuugcucucacacacuacgccgcgcagcccgggggauauuacaauggcaccagaggcgaccggaacaaacugcgccaucugaucagcgugaagcucgggaagauuccuacagucgaaaauucuaucuuccacauggccgcuugguccggaagcgccugccacgauggcaaagaguggaccuauauugggguggacggacccgauaacaaugcucugcuuaagaucaaauacggcgaggccuacacggacacauaucauucuuacgcgaacaauauucugagaacccaggaguccgccuguaacugcaucgggggaaauuguuaucucaugguuacagauggcagcgcuuccggcgugucugaaugccgguuucugaagauucgcgaggggagaaucaucaaagagauuuucccgaccggacgggucaagcacaccgaagaguguacaugcggcuuugccagcaacaagacgaucgaaugugcuugccgcgacaauuccuacaccgccaaaagaccuuucgugaaacuuaacguugagacagauaccgccgaaauucggcugaugugcacagacaccuaucucgauacgccccgcccugacgaugggagcaucacaggacccugugagucuaacggcgacaagggguccggaggcauuaagggcggguuugugcaucagagaauggcuagcaaaaucggacggugguacucucgcaccaugagcaagaccgagagaaugggcauggggcuguaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucacgacggcgggaaagagacauggcacagcgccgccaccgcuauuuauugccucaugggaucuggccaacugcuuugggauacagugacggggguggacauggcccuguga

SEQ ID NO: 212479 - RNA, 1401 nt, Artificial Sequence; identical to SEQ ID NO: 211985
  derived and/or modified sequence opt5 from neuraminidase__InfluenzaB__AGX19924

SEQ ID NO: 212480 - RNA, 1401 nt, Artificial Sequence; identical to SEQ ID NO: 211985
  derived and/or modified sequence opt5 from neuraminidase__InfluenzaB__AGX19935

SEQ ID NO: 212481 - RNA, 1401 nt, Artificial Sequence; identical to SEQ ID NO: 211985
  derived and/or modified sequence opt5 from neuraminidase__InfluenzaB__AGX19946

SEQ ID NO: 212482 - RNA, 1401 nt, Artificial Sequence; identical to SEQ ID NO: 211985
  derived and/or modified sequence opt5 from neuraminidase__InfluenzaB__AGX19957

SEQ ID NO: 212483 - RNA, 1401 nt, Artificial Sequence
  derived and/or modified sequence opt5 from neuraminidase__InfluenzaB__AGX19968
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuucugaaaauuagagaggggcggaucaucaaggagauuuucccgaccggacgcgugaagcacaccgaagaguguacaugcggcuuugccagcaacaaaacgaucgaaugugcuugcagagauaauuccuacaccgccaagcggccuuucguuaaacuuaacguggagacagacaccgccgaaauucgccugaugugcacagauaccuaucucgacacgcccagaccuaaugaugggagcaucacaggacccugugagucuaacggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcuggccuucucuggcgugauggucagcaugaaggagccugggugguacuccuuuggcuucgaaaucaaagacaagaaaugcgauguuccguguauuggaaucgagauggugcacgacggcgggaaggaaacauggcauagcgcugccaccgccauuuauugccucaugggaucuggccagcugcuuugggauacagugacgggggucaacauggcucuguga

SEQ ID NO: 212484 - RNA, 1401 nt, Artificial Sequence; identical to SEQ ID NO: 212437
  derived and/or modified sequence opt5 from neuraminidase__InfluenzaB__AGX19979

SEQ ID NO: 212485 - RNA, 1401 nt, Artificial Sequence; identical to SEQ ID NO: 212437
  derived and/or modified sequence opt5 from neuraminidase__InfluenzaB__AGX19990

SEQ ID NO: 212486 - RNA, 1401 nt, Artificial Sequence; identical to SEQ ID NO: 211985
  derived and/or modified sequence opt5 from neuraminidase__InfluenzaB__AGX20001

SEQ ID NO: 212487 - RNA, 1401 nt, Artificial Sequence; identical to SEQ ID NO: 211985
  derived and/or modified sequence opt5 from neuraminidase__InfluenzaB__AGX20012

SEQ ID NO: 212488 - RNA, 1401 nt, Artificial Sequence; identical to SEQ ID NO: 211985
  derived and/or modified sequence opt5 from neuraminidase__InfluenzaB__AGX20023

SEQ ID NO: 212489 - RNA, 1401 nt, Artificial Sequence; identical to SEQ ID NO: 211985
  derived and/or modified sequence opt5 from neuraminidase__InfluenzaB__AGX20034

SEQ ID NO: 212490 - RNA, 1401 nt, Artificial Sequence; identical to SEQ ID NO: 211985
  derived and/or modified sequence opt5 from neuraminidase__InfluenzaB__AGX20045

SEQ ID NO: 212491 - RNA, 1401 nt, Artificial Sequence
  derived and/or modified sequence opt5 from neuraminidase__InfluenzaB__AGX20056
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaugaucagagagcccuucauugccugcggcccuaacgaauguaagcauuuugcucucacacacuacgccgcgcagcccgggggauauuacaauggcacccggggcgaccgcaacaaacugagacaucugaucagcgucaagcucgggaagaucccuacaguggaaaauucuauuuuccacauggccgcuugguccggaagcgccugccaugauggcaaagaguggaccuauaucgggguugacggacccgauaacaaugcucugcuuaaggugaaauacggcgaggccuacacggacacauaucacucuuacgcgaacaagauucugcggacccaggaguccgccuguaauugcaucgggggaaacuguuaucucauggucacagauggcagcgcuuccggcgugucugaaugccgcuuucugaaaauuagagaggggcggaucauuaaggagaucuucccgaccggacgcguuaagcacaccgaagaguguacaugcggcuuugccagcaauaaaacgaucgaaugugcuugcagagacaacuccuacaccgccaagcggccuuucgugaaacuuaaugucgagacagauaccgccgaaauucgccugaugugcacagacaccuaucucgauacgcccagaccuaacgacgggagcaucacaggacccugugagucuaacggcgauaagggguccggaggcauuaaaggcggguuugugcaucaacggauggagagcaagaucggacgcugguacucuagaaccaugagcaaaaccgaacggaugggcauggggcuguaugugaaguacgacggagaccccugggcugauuccgacgcgcuggccuucucuggcgucaugguuagcaugaaggagccugggugguacuccuuuggcuucgaaauuaaagauaagaaaugcgacgugccguguaucggaaucgagauggugcacgauggcgggaaggaaacauggcauagcgcugccaccgccauuuauugccucaugggaucuggccagcugcuuugggacacagucacggggguggauauggcucuguga

SEQ ID NO: 212492 - RNA, 1401 nt, Artificial Sequence
  derived and/or modified sequence opt5 from neuraminidase__InfluenzaB__AGX20067
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucauggucacagauggcagcgcuuccggcgugucugaaugccgcuuucugaaaaucagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaaauccgccugaugugcacagacaccuaucucgauacgcccagaccuaacgacgggagcauuacaggacccugugagucuaacggcgauaagggguccggaggcaucaaaggcggguuugugcaucaacggauggagagcaagauuggacgcugguacucuagaaccaugagcaaaaccgaacggaugggcauggggcuguaugugaaguacgacggagaccccugggcugauuccgacgcgcuggccuucucuggcgucaugguuagcaugaaggagccugggugguacuccuuuggcuucgaaaucaaagauaagaaaugcgacgugccguguaucggaauugagauggugcacgauggcgggaaggaaacauggcauagcgcugccaccgccaucuauugccucaugggaucuggccagcugcuuugggacacagucacggggguggauauggcucuguga

SEQ ID NO: 212493 - RNA, 1401 nt, Artificial Sequence; identical to SEQ ID NO: 211985
  derived and/or modified sequence opt5 from neuraminidase__InfluenzaB__AGX20078

SEQ ID NO: 212494 - RNA, 1401 nt, Artificial Sequence; identical to SEQ ID NO: 211985
  derived and/or modified sequence opt5 from neuraminidase__InfluenzaB__AGX20089

SEQ ID NO: 212495 - RNA, 1401 nt, Artificial Sequence
  derived and/or modified sequence opt5 from neuraminidase__InfluenzaB__AGX20100
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcugugcugaaaaucaaguacggcgaagccuacacggacacauaucacucuuacgcgaauaacauucuucggacccaggaguccgccuguaauugcaucgggggaaacuguuaucugaugauuacagauggcagcgcuuccggcgucucugaaugccgcuuucucaaaaucagagaggggcggaucauuaaggagaucuucccgaccggacgcauucaacacaccgaagaguguacaugcggcuuugccagcaauaagacgaucgaaugugcuugcagagacaacuccuacaccgccaaacggccuuucgugaagcugaauguugagacagauaccgccgaaauucgccuuaugugcacaaaaaccuaucuggacacgcccagaccugaugacgggagcaucacaggacccugugagucuaacggcgggaagggauccggcggcaucaaagggggauuugugcaucagcggauggcuagcaagauuggccgcugguacucuagaaccaugagcaaaaccgagcggaaggggaugggacucuaugucaaguacgauggcgaccccugggcggacuccgaugcccuggcuuucucuggggugauggugagcauggaggaaccuggcugguacuccuuuggauucgaaaucaaagacaagaaaugcgaugucccguguauuggcaucgagaugguucacgacgggggaaaggaaacauggcauagcgccgccaccgcuauuuauugccugaugggcucugggcagcuccugugggauacagugacgggagugaacauggcccuuuga

SEQ ID NO: 212496 - RNA, 1401 nt, Artificial Sequence
  derived and/or modified sequence opt5 from neuraminidase__InfluenzaB__AGX20111
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccugacgaugggagcaucacaggacccugugagucuaacggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcugacauucucuggcgugauggucagcaugaaggagccugggugguacuccuuuggcuucgaaaucaaagacaagaaaugcgauguuccguguauuggaaucgagauggugcacgacggcgggaaggaaaccuggcauagcgccgcuacagccauuuauugccucaugggaucuggccagcugcuuugggauacggugaccggggucgacauggcccuguga

SEQ ID NO: 212497 - RNA, 1401 nt, Artificial Sequence
  derived and/or modified sequence opt5 from neuraminidase__InfluenzaB__AGX20122
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaaaccaagggaaauuccgcuccucugaucauucgggagccguuuaucgccugcggccccaacgaauguaaacauuucgcucucacacacuacgccgcgcagccugggggauauuacaauggcacccgcggcgacagaaacaagcugcggcaucugaucagcgucaaacucgggaagauucccacaguggaaaauucuaucuuucacauggccgcuugguccggaagcgccugccaugauggcaaggaguggaccuauauugggguugacggaccugauaacgacgcucugcuuaaagugaaguacggcgaggccuacacggauacauaucacucuuacgcgaauaaaauccugcgcacccaggaguccgccuguaacugcauugggggaaauuguuaucucaugaucacagacggcagcgcuuccggcgucucugaaugcagauuccugaagauucgggaggggcgcaucaucaaagagauuuuucccaccggaagagugaagcacaccgaagaguguacaugcggcuucgccagcaacaagacgaucgaaugugcuugccgggauaauuccuacaccgccaaacgcccguuuguuaaacuuaacguggagacagacaccgccgaaauuagacugaugugcacagauaccuaucucgacacgccucggcccgaugacgggagcaucacaggaccuugugagucuaauggcgacaagggguccggaggcauuaagggcggguucguccaucaacgcauggagagcaaaaucggaagaugguacucucggaccaugagcaagaccgaaagaaugggcauggggcuguaugugaaauacgauggagaccccugggcugauuccgacgcgcuggccuuuucuggcgugauggucagcaugaaggagcccgggugguacuccuucggcuucgaaaucaaggauaaaaagugcgacguuccuuguauuggaaucgagauggugcacgauggcgggaaagaaacauggcauagcgcugccaccgccauuuauugccucaugggaucuggccagcugcuuugggacacagugacgggggucgauauggcucuguga

SEQ ID NO: 212498 - RNA, 1401 nt, Artificial Sequence
  derived and/or modified sequence opt5 from neuraminidase__InfluenzaB__AGX20133
augcugcccagcaccauccagacacucacgcuguuccuuaccuccggcggggugcugcucucucuguacgucagcgcccuucuguccuaucuccuguacucugacguucugcucaaguuuagcccuacagagauuaccgcuccgacaaugucccuggauugcgccaacgcgucuaaugugcaagcugugaacagaagcgccaccaaaggagucacauuccuucugcccgaaccugaguggaccuauccccggcucuccuguccuggcagcacguuucagaaggcccugcuuaucucuccccaccgcuucggggaaaccaaaggaaauuccgcuccucugauuaucagagagccguuuauugccugcggccccaacgaauguaagcauuucgcucucacacacuacgccgcgcagccugggggauauuacaauggcacccggggcgaccgcaacaaacugagacaucugaucagcgugaagcucgggaagauccccacaguugaaaauucuauuuuucacauggccgcuugguccggaagcgccugccaugauggcaaagaguggaccuauaucgggguggacggaccugauaacgacgcucugcuuaaggucaaauacggcgaggccuacacggauacauaucacucuuacgcgaauaagauucugcggacccaggaguccgccuguaacugcaucgggggaaauuguuaucucaugauuacagacggcagcgcuuccggcgugucugaaugccgcuuccugaaaaucagagaggggcggauuaucaaggagaucuuucccaccggacgcguuaagcacaccgaagaguguacaugcggcuucgccagcaacaaaacgauugaaugugcuugcagagauaauuccuacaccgccaagcggccguuugugaaacuuaacgucgagacagacaccgccgaaauccgccugaugugcacagauaccuaucucgacacgccuagacccgaugacgggagcauuacaggaccuugugagucuaauggcgacaagggguccggaggcaucaaaggcggguucgugcaucaacggauggagagcaagauuggacgcugguacucuagaaccaugagcaaaaccgaacggaugggcauggggcuguaugugaaguacgauggagaccccugggcugauuccgacgcgcuggccuuuucuggcgucaugguuagcaugaaggagcccgggugguacuccuucggcuucgaaaucaaagauaagaaaugcgacgugccuuguaucggaauugagauggugcacgauggcgggaaggaaacauggcauagcgcugccaccgccaucuauugccucaugggaucuggccagcugcuuugggacacagucacggggguggauauggcucuguga

SEQ ID NO: 212499 - RNA, 1401 nt, Artificial Sequence
  derived and/or modified sequence opt5 from neuraminidase__InfluenzaB__AGX20144
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcauuucugaaugccgcuuccugaaaaucagagaggggcggaucauuaaggagaucuuucccaccggacgcgucaagcacaccgaagaguguacaugcggcuucgccagcaacaaaacgauugaaugugcuugcagagauaauuccuacaccgccaagcggccguuugugaaacuuaacguugagacagacaccgccgaaauccgccugaugugcacagauaccuaucucgacacgccuagacccgaugacgggagcauuacaggaccuugugagucuaauggcgacaagggguccggaggcaucaaaggcggguucgugcaucaacggauggagagcaagaucggacgcugguacucuagaaccaugagcaaaaccgaacggaugggcauggggcuguaugucaaguacgauggagaccccugggcugauuccgacgcgcuggccuuuucuggcgugauggugagcaugaaggagcccgggugguacuccuucggcuucgaaauuaaagauaagaaaugcgacgucccuuguaucggaauugagaugguucacgauggcgggaaggaaacauggcauagcgcugccaccgccaucuauugccucaugggaucuggccagcugcuuugggacacagugacggggguggauauggcucuguga

SEQ ID NO: 212500 - RNA, 1401 nt, Artificial Sequence; identical to SEQ ID NO: 212499
  derived and/or modified sequence opt5 from neuraminidase__InfluenzaB__AGX20155

SEQ ID NO: 212501 - RNA, 1401 nt, Artificial Sequence; identical to SEQ ID NO: 212499
  derived and/or modified sequence opt5 from neuraminidase__InfluenzaB__AGX20166

SEQ ID NO: 212502 - RNA, 1401 nt, Artificial Sequence; identical to SEQ ID NO: 211919
  derived and/or modified sequence opt5 from neuraminidase__InfluenzaB__AGX20177

SEQ ID NO: 212503 - RNA, 1401 nt, Artificial Sequence; identical to SEQ ID NO: 211919
  derived and/or modified sequence opt5 from neuraminidase__InfluenzaB__AGX20188

SEQ ID NO: 212504 - RNA, 1401 nt, Artificial Sequence; identical to SEQ ID NO: 211896
  derived and/or modified sequence opt5 from neuraminidase__InfluenzaB__AGX20199

SEQ ID NO: 212505 - RNA, 1401 nt, Artificial Sequence; identical to SEQ ID NO: 211919
  derived and/or modified sequence opt5 from neuraminidase__InfluenzaB__AGX20210

SEQ ID NO: 212506 - RNA, 1401 nt, Artificial Sequence; identical to SEQ ID NO: 212499
  derived and/or modified sequence opt5 from neuraminidase__InfluenzaB__AGX20221

SEQ ID NO: 212507 - RNA, 1401 nt, Artificial Sequence
  derived and/or modified sequence opt5 from neuraminidase__InfluenzaB__AGX20232
augcugcccagcaccauccagacacucacgcuguuccuuaccuccggcggggugcugcucucucuguacgucagcgccucccuuucuuaucugcucuacagcgggauucugcugaaguuuuccccuacagagaucaccgcuccgacaaugccccucgacugcgccaacgcgucuaauguucaagcugugaacagaagcgccaccaaaggcgugacauuccugcuuccugaacccgaguggaccuauccucggcuguccugucccgggagcacguuucagaaggcccuccugauuucuccucaccgcuucggagaaaccaaaggcaauuccgcuccgcuuaucauuagagagcccuuuaucgccugcgggccuaacgaauguaagcauuucgcucugacacacuacgccgcgcagcccggaggcuauuacaauggcacccggggagaucgcaacaaacucagacaucugaucagcgucaagcugggaaagauuccuacaguggaaaauucuaucuuucacauggccgcuugguccggcagcgccugccaugacgggaaagaguggaccuauauuggaguugauggccccgacaacaaugcucuccugaaggugaaauacggggaggccuacacggauacauaucacucuuacgcgaacaagauccuucggacccaggaguccgccuguaauugcauuggaggcaacuguuaucugaugaucacagacggcagcgcuuccggggucucugaaugccgcuuccucaaaauuagagagggacggaucaucaaggagauuuuuccgaccggccgcgugaagcacaccgaagaguguacaugcggguucgccagcaaugaaacgaucgagugugcuugcagagauaacuccuacaccgccaaacggccuuuuguuaagcugaauguggaaacagacaccgccgagauucgccuuaugugcacagauaccuaucuggacacgcccagaccuaacgauggaagcaucacaggccccugugagucuaacggggacaaaggaggcggcgggauuaagggaggcuucguccaucaacggauggaauccaaaaucgggcgcugguacagcagaaccaugucuaagaccgagcggaugggaaugggccucuaugugaaauacgauggggaccccugggcugacagcgaugcgcuggccuuuuccggcgugauggucucuaugaaggaaccuggaugguacagcuucggcuucgagaucaaggacaaaaagugcgauguuccguguauugggaucgaaauggugcacgacggaggcaaagagacauggcauuccgcugccaccgccauuuauugccugauggggagcggacagcuccugugggauacagugacgggcgucgacauggcucuuuga

SEQ ID NO: 212508 - RNA, 1401 nt, Artificial Sequence; identical to SEQ ID NO: 211919
  derived and/or modified sequence opt5 from neuraminidase__InfluenzaB__AGX20243

SEQ ID NO: 212509 - RNA, 1401 nt, Artificial Sequence; identical to SEQ ID NO: 212499
  derived and/or modified sequence opt5 from neuraminidase__InfluenzaB__AGX20254

SEQ ID NO: 212510 - RNA, 1401 nt, Artificial Sequence; identical to SEQ ID NO: 211896
  derived and/or modified sequence opt5 from neuraminidase__InfluenzaB__AGX20265

SEQ ID NO: 212511 - RNA, 1401 nt, Artificial Sequence; identical to SEQ ID NO: 212499
  derived and/or modified sequence opt5 from neuraminidase__InfluenzaB__AGX20276

SEQ ID NO: 212512 - RNA, 1401 nt, Artificial Sequence; identical to SEQ ID NO: 211919
  derived and/or modified sequence opt5 from neuraminidase__InfluenzaB__AGX20287

SEQ ID NO: 212513 - RNA, 1401 nt, Artificial Sequence
  derived and/or modified sequence opt5 from neuraminidase__InfluenzaB__AGX20298
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaacauggcagagcgcugccaccgccauuuauugccucaugggaucuggccagcugcuuugggacacagugacgggggucgauauggcucuguga

SEQ ID NO: 212514 - RNA, 1401 nt, Artificial Sequence; identical to SEQ ID NO: 211896
  derived and/or modified sequence opt5 from neuraminidase__InfluenzaB__AGX20320

SEQ ID NO: 212515 - RNA, 1401 nt, Artificial Sequence; identical to SEQ ID NO: 211919
  derived and/or modified sequence opt5 from neuraminidase__InfluenzaB__AGX20331

SEQ ID NO: 212516 - RNA, 1401 nt, Artificial Sequence
  derived and/or modified sequence opt5 from neuraminidase__InfluenzaB__AGX20342
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucauggucacagauggcagcgcuuccggcgugucugaaugccgcuuucugaaaaucagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggagagcaagauuggacgcugguacucuagaaccaugagcaaaaccgaacggaugggcauggggcuguaugugaaguacgacggagaucccugggcugacuccgaugcgcuggccuucucuggcgucaugguuagcaugaaggagccugggugguacuccuuuggcuucgaaaucaaagacaagaaaugcgaugugccguguaucggaauugagauggugcacgacggcgggaaggaaacauggcauagcgcugccaccgccaucuauugccucaugggaucuggccagcugcuuugggauacagucacggggguggacauggcucuguga

SEQ ID NO: 212517 - RNA, 1401 nt, Artificial Sequence
  derived and/or modified sequence opt5 from neuraminidase__InfluenzaB__AGX20353
augcugcccagcaccauccagacacucacgcuguuccuuaccuccggcggggugcugcucucucuguacgucagcgcccuucuguccuaucuccuguacucugacauucugcucaaguuuagcccuacagagaucauugcuccgaccaugucccuggauugcgccaacgcgucuaauguucaagcugugaacagaagcgccacaaaaggagugaccuuccuucugcccgaaccugaguggacauauccccggcucuccuguccuggcagcaccuuucagaaggcccugcuuaucucuccccaccgcuucggggaaacgaaaggaaauuccgcuccucugauuaucagagagccguuuaucgccugcggccccaacgaauguaagcauuucgcucucacccacuacgccgcgcagccugggggauauuacaaucggacacgcggcgacagaaacaaacugcggcaucugauuagcgucaagcucggcaagauccccaccguggaaaauucuauuuuucacauggccgcuugguccgggagcgccugccaugauggaaaagaguggacauauaucggcguugacgggccugauaacgacgcucugcuuaaggugaaauacggagaggccuacaccgauacguaucacucuuacgcgaauaagauucugcgcacacaggaguccgccuguaacugcaucggcgggaauuguuaucucaugauuaccgacggaagcgcuuccggcaucucugaaugcagauuccugaaaauccgggagggccgcauuaucaaggagauuuuucccacagggagagucaagcacaccgaagaguguaccugcggauucgccagcaacaaaacaaucgaaugugcuugccgggauaauuccuacacggccaagcgcccguuugugaaacuuaacguugagaccgacacagccgaaauuagacugaugugcaccgauacauaucucgacaccccucggcccgaugacggcagcaucacggggccuugugagucuaauggagacaagggcuccgggggaaucaaaggcggcuucgugcaucaacgcauggagagcaagauugggagaugguacucucggacaaugagcaaaaccgaaagaaugggaaugggccuguaugucaaguacgauggggaccccugggcugauuccgacgcgcuggccuuuucuggagugauggugagcaugaaggagcccggcugguacuccuucggguucgaaaucaaagauaagaaaugcgacgucccuuguauuggcaucgagaugguucacgauggaggcaaggaaaccuggcauagcgcugccacagccauuuauugccucauggggucuggacagcugcuuugggacaccgugacaggcguggauauggcucuguga

SEQ ID NO: 212518 - RNA, 1401 nt, Artificial Sequence; identical to SEQ ID NO: 211919
  derived and/or modified sequence opt5 from neuraminidase__InfluenzaB__AGX20364

SEQ ID NO: 212519 - RNA, 1401 nt, Artificial Sequence; identical to SEQ ID NO: 211914
  derived and/or modified sequence opt5 from neuraminidase__InfluenzaB__AGX20375

SEQ ID NO: 212520 - RNA, 1401 nt, Artificial Sequence
  derived and/or modified sequence opt5 from neuraminidase__InfluenzaB__AGX20386
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggacccacccccggcucuccuguccuggcagcacguuucagaaggcccugcuuauuucuccccaucgcuucggggaaaccaaaggaaauuccgcuccucugaucauuagagagccguuuaucgccugcggccccaacgaauguaagcacuucgcucucacacauuaugccgcgcagccugggggauacuauaauggcacccggggcgaccgcaacaaacugagacaccugaucagcgucaagcucgggaagauucccacaguggaaaauucuaucuuucauauggccgcuugguccggaagcgccugccacgauggcaaagaguggaccuacauugggguugacggaccugauaacgacgcucugcuuaaggugaaauauggcgaggccuacacggauacauaccacucuuaugcgaauaagauccugcggacccaggaguccgccuguaacugcauugggggaaauuguuaccucaugaucacagacggcagcgcuuccggcauuucugaaugccgcuuccugaaaaucagagaggggcggaucauuaaggagaucuuucccaccggacgcgucaagcauaccgaagaguguacaugcggcuucgccagcaacaaaacgauugaaugugcuugcagagauaauuccuauaccgccaagcggccguuugugaaacuuaacguugagacagacaccgccgaaauccgccugaugugcacagauaccuaccucgacacgccuagacccgaugacgggagcauuacaggaccuugugagucuaauggcgacaagggguccggaggcaucaaaggcggguucgugcaccaacggauggagagcaagaucggacgcugguauucuagaaccaugagcaaaaccgaacggaugggcauggggcuguacgucaaguaugauggagaccccugggcugauuccgacgcgcuggccuuuucuggcgugauggugagcaugaaggagcccgggugguacuccuucggcuucgaaauuaaagauaagaaaugcgacgucccuuguaucggaauugagaugguucaugauggcgggaaggaaacauggcacagcgcugccaccgccaucuacugccucaugggaucuggccagcugcuuugggacacagugacggggguggauauggcucuguga

SEQ ID NO: 212521 - RNA, 1401 nt, Artificial Sequence; identical to SEQ ID NO: 211919
  derived and/or modified sequence opt5 from neuraminidase__InfluenzaB__AGX20397

SEQ ID NO: 212522 - RNA, 1401 nt, Artificial Sequence; identical to SEQ ID NO: 211914
  derived and/or modified sequence opt5 from neuraminidase__InfluenzaB__AGX20408

SEQ ID NO: 212523 - RNA, 1401 nt, Artificial Sequence; identical to SEQ ID NO: 211896
  derived and/or modified sequence opt5 from neuraminidase__InfluenzaB__AGX20419

SEQ ID NO: 212524 - RNA, 1401 nt, Artificial Sequence
  derived and/or modified sequence opt5 from neuraminidase__InfluenzaB__AGX20430
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaagcuaagggaaauuccgccccucugaucauucgggagccguuuaucgcuugcggccccaacgaauguaaacauuucgcccucacccacuacgcggcccagccugggggauauuacaauggcacacgcggcgacagaaacaagcugcggcaucugaucagcgucaaacucgggaagauucccaccguggaaaauucuaucuuucacauggcugccugguccggaagcgcuugccaugauggcaaggaguggacauauauugggguugacggaccugauaacgacgcccugcuuaaagugaaguacggcgaggcguacaccgauacguaucacucuuacgccaauaaaauccugcgcacacaggaguccgcuuguaacugcauugggggaaauuguuaucucaugaucaccgacggcagcgccuccggcgucucugaaugcagauuccugaagauucgggaggggcgcaucaucaaagagauuuuucccacaggaagagugaagcacaccgaagaguguaccugcggcuucgcuagcaacaagacaaucgaaugugccugccgggauaauuccuacacggccaaacgcccguuuguuaaacuuaacguggagaccgacacagcugaaauuagacugaugugcaccgauacauaucucgacaccccucggcccgaugacgggagcaucacgggaccuugugagucuaauggcgacaagggguccggaggcauuaagggcggguucguccaucaacgcauggagagcaaaaucggaagaugguacucucggacaaugagcaagaccgaaagaaugggcauggggcuguaugugaaauacgauggagaccccugggcggauuccgacgcccuggcuuuuucuggcgugauggucagcaugaaggagcccgggugguacuccuucggcuucgaaaucaaggauaaaaagugcgacguuccuuguauuggaaucgagauggugcacgauggcgggaaagaaaccuggcauagcgccgccacagcuauuuauugccucaugggaucuggccagcugcuuugggacaccgugacaggggucgauauggcccuguga

SEQ ID NO: 212525 - RNA, 1401 nt, Artificial Sequence; identical to SEQ ID NO: 211896
  derived and/or modified sequence opt5 from neuraminidase__InfluenzaB__AGX20441

SEQ ID NO: 212526 - RNA, 1401 nt, Artificial Sequence
  derived and/or modified sequence opt5 from neuraminidase__InfluenzaB__AGX20452
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggagugacauuccugcuucccgaaccugaguggaccuauccccggcugagcuguccuggcucuacguuucagaaggcccuccugauuagcccccaccgcuucggggaaaccaaaggaaauuccgcuccucuuaucauuagagagccguuuaucgccugcggccccaacgaauguaagcauuucgcucugacacacuacgccgcgcagccugggggauauuacaauggcacccggggcgaccgcaacaaacucagacaucugaucucugucaagcuggggaagauucccacaguggaaaauuccaucuuucacauggccgcuuggagcggaucugccugccaugauggcaaagaguggaccuauauugggguugacggaccugauaacgacgcucuccugaaggugaaauacggcgaggccuacacggauacauaucacuccuacgcgaauaagauccuucggacccaggagagcgccuguaacugcauugggggaaauuguuaucugaugaucacagacggcuccgcuucuggcgucagcgaaugccgcuuccucaaaauuagagaggggcggaucaucaaggagauuuuucccaccggacgcgugaagcacaccgaagaguguacaugcggcuucgccuccaacaaaacgaucgaaugugcuugcagagauaauagcuacaccgccaagcggccguuuguuaaacugaacguggagacagacaccgccgaaauucgccuuaugugcacagauaccuaucuggacacgccuagacccgaugacgggucuaucacaggaccuugugaguccaauggcgacaaggggagcggaggcauuaaaggcggguucguccaucaacggauggagucuaagaucggacgcugguacagcagaaccauguccaaaaccgaacggaugggcauggggcucuaugugaaguacgauggagaccccugggcugauucugacgcgcuggccuuuagcggcgugauggucuccaugaaggagcccgggugguacagcuucggcuucgaaaucagagauaaaaagugcgacguuccuuguauuggaaucgagauggugcacgauggcgggaaagaaacauggcauucugcugccaccgccauuuauugccugaugggauccggccagcuccugugggacacagugacgggggucgauauggcucuuuga

SEQ ID NO: 212527 - RNA, 1401 nt, Artificial Sequence; identical to SEQ ID NO: 211919
  derived and/or modified sequence opt5 from neuraminidase__InfluenzaB__AGX20463

SEQ ID NO: 212528 - RNA, 1401 nt, Artificial Sequence; identical to SEQ ID NO: 211919
  derived and/or modified sequence opt5 from neuraminidase__InfluenzaB__AGX20474

SEQ ID NO: 212529 - RNA, 1401 nt, Artificial Sequence; identical to SEQ ID NO: 211919
  derived and/or modified sequence opt5 from neuraminidase__InfluenzaB__AGX20485

SEQ ID NO: 212530 - RNA, 1401 nt, Artificial Sequence; identical to SEQ ID NO: 212499
  derived and/or modified sequence opt5 from neuraminidase__InfluenzaB__AGX20496

SEQ ID NO: 212531 - RNA, 1401 nt, Artificial Sequence; identical to SEQ ID NO: 211919
  derived and/or modified sequence opt5 from neuraminidase__InfluenzaB__AGX20507

SEQ ID NO: 212532 - RNA, 1401 nt, Artificial Sequence; identical to SEQ ID NO: 211919
  derived and/or modified sequence opt5 from neuraminidase__InfluenzaB__AGX20518

SEQ ID NO: 212533 - RNA, 1401 nt, Artificial Sequence
  derived and/or modified sequence opt5 from neuraminidase__InfluenzaB__AGX20529
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaauguaccugcagagauaauuccuacacagcuaagcggccguuuguuaaacuuaacguggagaccgacacagccgaaauucgccugaugugcaccgauacguaucucgacacaccuagacccgaugacgggagcaucaccggaccuugugagucuaauggcgacaagggguccggaggcauuaaaggcggguucguccaucaacggauggagagcaagaucggacgcugguacucuagaaccaugagcaaaacagaacggaugggcauggggcuguaugugaaguacgauggagaccccugggccgauuccgacgcucuggcguuuucuggcgugauggucagcaugaaggagcccgggugguacuccuucggcuucgaaaucaaagauaagaaaugcgacguuccuuguauuggaaucgagauggugcacgauggcgggaaggaaaccuggcauagcgccgcuacagccauuuauugccucaugggaucuggccagcugcuuugggacacggugaccggggucgauauggcccuguga

SEQ ID NO: 212534 - RNA, 1401 nt, Artificial Sequence; identical to SEQ ID NO: 212497
  derived and/or modified sequence opt5 from neuraminidase__InfluenzaB__AGX20540

SEQ ID NO: 212535 - RNA, 1401 nt, Artificial Sequence; identical to SEQ ID NO: 212143
  derived and/or modified sequence opt5 from neuraminidase__InfluenzaB__AGX20551

SEQ ID NO: 212536 - RNA, 1401 nt, Artificial Sequence; identical to SEQ ID NO: 211896
  derived and/or modified sequence opt5 from neuraminidase__InfluenzaB__AGX20562

SEQ ID NO: 212537 - RNA, 1401 nt, Artificial Sequence; identical to SEQ ID NO: 211919
  derived and/or modified sequence opt5 from neuraminidase__InfluenzaB__AGX20573

SEQ ID NO: 212538 - RNA, 1401 nt, Artificial Sequence
  derived and/or modified sequence opt5 from neuraminidase__InfluenzaB__AGX20584
augcugcccagcaccauccagacacucacgcuguuccuuaccuccggcggggugcugcucucucuguacgucagcgccucccuuucuuaucugcucuacagcgacauucugcugaaguuuuccucuacagagaucaccgcuccuacaaugccgcucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacaaugcucugcuuaaggugaaauacggcgaggccuacacggacacauaucacuccuacgcgaacaagauccugcggacccaggagagcgccuguaauugcauugggggaaacuguuaucucaugaucacagauggcuccgcuucuggcgucagcgaaugccgcuuucugaaaauuagagaggggcggaucaucaaggagauuuuccccaccggacgcgugaagcacaccgaagaguguacaugcggcuuugccuccaauaaaacgaucgaaugugcuugcagagacaacagcuacaccgccaagcggccguucguuaaacuuaauguggagacagauaccgccgaaauucgccugaugugcacagacaccuaucucgauacgccuagacccaacgacgggucuaucacaggaccuugugaguccaacggcgauaaggggagcggaggcauuaaaggcggguuuguccaucaacggauggagucucgcaucggaagaugguacagccggaccauguccaagaccgaaagaaugggcauggggcuguaugugaaauacgacggagaccccuggacagauucugacgcucugaccuucagcggcgugauggucuccaugaaggagcccgggugguacagcuuuggcuucgaaaucaaggauaaaaagugcgacguuccuuguauuggaaucgagauggugcacgauggcgggaaagaaacauggcauucugcggccacggcuauuuauugccucaugggauccggccagcugcuuugggacaccgugacaggggucgauauggcccuguga

SEQ ID NO: 212539 - RNA, 1401 nt, Artificial Sequence; identical to SEQ ID NO: 211919
  derived and/or modified sequence opt5 from neuraminidase__InfluenzaB__AGX20595

SEQ ID NO: 212540 - RNA, 1401 nt, Artificial Sequence; identical to SEQ ID NO: 212497
  derived and/or modified sequence opt5 from neuraminidase__InfluenzaB__AGX20606

SEQ ID NO: 212541 - RNA, 1401 nt, Artificial Sequence; identical to SEQ ID NO: 212497
  derived and/or modified sequence opt5 from neuraminidase__InfluenzaB__AGX20617

SEQ ID NO: 212542 - RNA, 1401 nt, Artificial Sequence; identical to SEQ ID NO: 212524
  derived and/or modified sequence opt5 from neuraminidase__InfluenzaB__AGX20628

SEQ ID NO: 212543 - RNA, 1401 nt, Artificial Sequence; identical to SEQ ID NO: 211924
  derived and/or modified sequence opt5 from neuraminidase__InfluenzaB__AGX20639

SEQ ID NO: 212544 - RNA, 1401 nt, Artificial Sequence
  derived and/or modified sequence opt5 from neuraminidase__InfluenzaB__AGX20650
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccacauguaacugcauugggggaaauuguuaucucaugaucaccgacggcagcgccuccggcgucucugaaugccgcuuccugaaaauuagagaggggcggaucaucaaggagauuuuucccaccggacgcgugaagcacacagaagaguguacgugcggcuucgcuagcaacaaaaccaucgaaugugccugcagagauaauuccuacacagcuaagcggccguuuguuaaacuuaacguggagaccgacacagccgaaauucgccugaugugcaccgauacguaucucgacacaccuagacccgaugacgggagcaucaccggaccuugugagucuaauggcgacaagggguccggaggcauuaaaggcggguucguccaucaacggauggagagcaagaucggacgcugguacucuagaaccaugagcaaaacagaacggaugggcauggggcuguaugugaaguacgauggagaccccugggccgauuccgacgcucuggcguuuucuggcgugauggucagcaugaaggagcccgggugguacuccuucggcuucgaaaucaaagauaagaaaugcgacguuccuuguauuggaaucgagauggugcacgauggcgggaaggaaaccuggcauagcgccgcuacagccauuuauugccucaugggaucuggccagcugcuuugggacacggugaccggggucgauauggcccuguga

SEQ ID NO: 212545 - RNA, 1401 nt, Artificial Sequence
  derived and/or modified sequence opt5 from neuraminidase__InfluenzaB__AGX20661
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaaucucgggaagauuccuacaguggagaacucuaucuuccacauggccgcuugguccggaagcgccugccaugauggcaaggaguggaccuauauugggguugacggacccgauaauaacgcucugcuuaaagugaaguacggcgaagccuacacggacacauaucacucuuacgcgaauaacauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaaacacaccgaagaguguacaugcggcuuugccagcaauaagacgaucgaaugugcuugcagagacaacuccuacaccgccaagcggccuuucguuaaacuuaacguggagacagauaccgccgaaauucgccugaugugcacagacaccuaucucgauacgcccagaccuaaugacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccuggacagauuccgacgcucuggcguucucuggcgugauggucagcaugaaagagccugggugguacuccuuuggcuucgaaaucaaggauaagaaaugcgacguuccguguauuggaaucgagauggugcacgauggcgggaaggaaaccuggcauagcgccgcuacagccauuuauugccucaugggaucuggccagcugcuuugggacacggugaccggggucgauauggcccuguga

SEQ ID NO: 212546 - RNA, 1401 nt, Artificial Sequence; identical to SEQ ID NO: 211980
  derived and/or modified sequence opt5 from neuraminidase__InfluenzaB__AGX20683

SEQ ID NO: 212547 - RNA, 1401 nt, Artificial Sequence; identical to SEQ ID NO: 212143
  derived and/or modified sequence opt5 from neuraminidase__InfluenzaB__AGX20694

SEQ ID NO: 212548 - RNA, 1401 nt, Artificial Sequence
  derived and/or modified sequence opt5 from neuraminidase__InfluenzaB__AGX20705
augcugcccagcaccauccagacacucacgcuguuccuuaccuccggcggggugcugcucucucuguacgucagcgccucccuuucuuaucugcucuacagcgggauucugcugaaguuuuccccuacagagaucaccgcuccgacaaugccccucgacugcgccaacgcgucugauguucaagcugugaauagaagcgccaccaaaggcgugacacugcuucugccugaacccgaguggaccuauccucggcucuccugucccgggagcacguuccagaaggcccugcuuauuucuccucaccgcuuuggagaaaccaaaggcaacuccgcuccgcugaucauuagagagcccuucaucgccugcgggccuaaugaauguaagcauuuugcucucacacacuacgccgcgcagcccggaggcuauuacaacggcacccggggagaccgcaauaaacugagacaucugaucagcgucaagcucggaaagauuccuacaguggagaacucuaucuuccacauggccgcuugguccggcagcgccugccaugaugggaaagaguggaccuauauuggaguugacggccccgauaauaacgcucugcuuaaggugaaauacggggaagccuacacggacacauaucacucuuacgcgaauaagauccugcggacccaggaguccgccuguaacugcauuggaggcaauuguuaucucaugaucacagauggcagcgcuuccggggucucugaaugccgcuuucugaaaauuagagagggacggaucaucaaggagauuuucccgaccggccgcgugaagcacaccgaagaguguacaugcggguuugccagcaacaaaacgaucgaaugugcuugcagagacaauuccuacaccgccaagcggccuuucguuaaacuuaacguggagacagauaccgccgaaauucgccugaugugcacagacaccuaucucgauacgcccagaccuaaugacggaagcaucacaggccccugugagucuaacggggauaagggauccggcggcauuaaagggggauuuguccaucaacggauggagagcaagaucggccgcugguacucuagaaccaugagcaaaaccgaacggauggggaugggacuguaugugaaguacgacggcgaccccugggcugauuccgacgcgcugacauucucuggggugauggucagcaugaaggagccuggcugguacuccuuuggauucgaaaucaaagauaagaaaugcgacguuccguguauuggcaucgagauggugcacgaugggggaaaggaaaccuggcauagcgccgcuacagccauuuauugccucaugggcucugggcagcugcuuugggacacggugaccggagucgauauggcccuguga

SEQ ID NO: 212549 - RNA, 1401 nt, Artificial Sequence
  derived and/or modified sequence opt5 from neuraminidase__InfluenzaB__AGX20716
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggaucgagagccgcaucggaagaugguacucucggaccaugagcaagaccgaaagaaugggcauggggcuguaugugaaauacgacggagaucccugggcugacuccgaugcgcuggccuucucuggcgugauggucagcaugaaggagccugggugguacuccuuuggcuucgaaauuaaggacaaaaagugcgauguuccguguaucggaauugagauggugcacgacggcgggaaagaaacauggcauagcgcugccaccgccaucuauugccucaugggaucuggccagcugcuuugggauacagugacgggggucgacauggcucuguga

SEQ ID NO: 212550 - RNA, 1401 nt, Artificial Sequence
  derived and/or modified sequence opt5 from neuraminidase__InfluenzaB__AGX20727
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcacaaccggaccuugugagucuaauggcgacaagggguccggaggcaucaaaggcggguucguccaucaacggauggagagcaagauuggacgcugguacucuagaaccaugagcaaaacagaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguaucggaauugagauggugcacgauggcgggaaggaaaccuggcauagcgcugccacagccaucuauugccucaugggaucuggccagcugcuuugggacacggugaccggggucgauauggcucuguga

SEQ ID NO: 212551 - RNA, 1401 nt, Artificial Sequence; identical to SEQ ID NO: 212143
  derived and/or modified sequence opt5 from neuraminidase__InfluenzaB__AGX20738

SEQ ID NO: 212552 - RNA, 1401 nt, Artificial Sequence; identical to SEQ ID NO: 211919
  derived and/or modified sequence opt5 from neuraminidase__InfluenzaB__AGX20749

SEQ ID NO: 212553 - RNA, 1401 nt, Artificial Sequence
  derived and/or modified sequence opt5 from neuraminidase__InfluenzaB__AGX20760
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggauggagagccgcaucggaagaugguacucucggaccaugagcaagaccgaaagaaugggcauggggcuguaugugaaauacgacggagaucccugggcugacuccgaugcgcuggccuucucuggcgugauggucagcaugaaggagccugggugguacuccuuuggcuucgaaaucaaggacaaaaagugcgauguuccguguauuggaaucgagauggugcacgacggcgggaaagaaacauggcauagcgcugccaccgccauuuauugccucaugggaucuggccagcugcuuugggauacagugacgggggucgacauggcucuguga

SEQ ID NO: 212554 - RNA, 1401 nt, Artificial Sequence; identical to SEQ ID NO: 211919
  derived and/or modified sequence opt5 from neuraminidase__InfluenzaB__AGX20771

SEQ ID NO: 212555 - RNA, 1401 nt, Artificial Sequence
  derived and/or modified sequence opt5 from neuraminidase__InfluenzaB__AGX20782
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuucccaucgguuuggggaaaccaaaggaaauagcgcuccucugaucauucgcgagccguucgucgccugcggccccaacgaauguaagcacuuugcucucacacauuacgccgcgcagccugggggauauuacaauggcaccagaggcgaccggaacaaacugcgccaccugaucucugugaagcucgggaagauccccacaguugaaaauuccauuuuccauauggccgcuuggagcggaucugccugccacgauggcaaagaguggaccuauaucgggguggacggaccugauaacaaugcucugcuuaaggucaaauacggcgaggccuacacggacacauaucacuccuacgcgaacaagauucugagaacccaggagagcgccuguaauugcaucgggggaaacuguuaucucaugauuacagauggcuccgcuucuggcgugagcgaaugccgguuucugaaaauccgcgaggggagaauuaucaaggagaucuuccccaccggacggguuaagcauaccgaagaguguacaugcggcuuugccuccaauaaaacgauugaaugugcuugccgcgacaacagcuacaccgccaagagaccguucgugaaacuuaaugucgagacagauaccgccgaaauccggcugaugugcacagacaccuaucucgauacgccucgccccaacgacgggucuauuacaggaccuugugaguccgauggcgacaaggggagcggaggcaucaaaggcggguuugugcaccaaagaauggagucuaagauuggacggugguacagccgcaccauguccagaaccgaacggaugggcauggggcuguaugugaaauacgacggagaucccugggcugacucugaugcgcuggccuucagcggcgucaugguuuccaugaaggagcccgggugguacagcuuuggcuucgaaaucaaggacaaaaagugcgaugugccuuguaucggaauugagauggugcaugacggcgggaaagaaacauggcacucugcugccaccgccaucuauugccucaugggauccggccagcugcuuugggauacagucacggggguggacauggcucuguga

SEQ ID NO: 212556 - RNA, 1401 nt, Artificial Sequence
  derived and/or modified sequence opt5 from neuraminidase__InfluenzaB__AGX20793
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacaccucuaauguucaagcggugaacagaagcgcuacaaaaggagugaccuuccuucugcccgaaccugaguggacguauccccggcucuccuguccuggcagcaccuuucagaaggcccugcuuauuucuccccaccgcuucggggaaacaaaaggaaauuccgccccucugaucauuagagagccguuuaucgcuugcggccccaacgaauguaagcauuucgcccucacccacuacgcugcccagccugggggauauuacaauggcacacggggcgaccgcaacaaacugagacaucugaucagcgucaagcucgggaagauucccaccguggaaaauucuaucuuucacauggcggccugguccggaagcgcuugccaugauggcaaagaguggacguauauugggguugacggaccugauaacgacgcccugcuuaaggugaaauacggcgaggcuuacacagauaccuaucacucuuacgccaauaagauccugcggacacaggaguccgcguguaacugcauugggggaaauuguuaucucaugaucaccgacggcagcgccuccggcgucucugaaugccgcuuccugaaaauuagagaggggcggaucaucaaggagauuuuucccaccggacgcgugaagcacacagaagaguguacgugcggcuucgcuagcaacaaaaccaucgaaugugccugcagagauaauuccuacacagcuaagcggccguuuguuaaacuuaacguggagaccgacacagccgaaauucgccugaugugcaccgauacguaucucgacacaccuagacccgaugacgggagcaucaccggaccuugugagucuaauggcgacaagggguccggaggcauuaaaggcggguucguccaucaacggauggagagcaagaucggacgcugguacucuagaaccaugagcaaaacagaacggaugggcauggggcuguaugugaaguacgauggagaccccugggccgauuccgacgcucuggcguuuucuggcgugauggucagcaugaaggagcccgggugguacuccuucggcuucgaaaucaaagauaagaaaugcgacguuccuuguauuggaaucgagauggugcacgauggcgggaaggaaaccuggcauagcgccgcuacagccauuuauugccucaugggaucuggccagcugcuuugggacacggugaccggggucaacauggcccuguga

SEQ ID NO: 212557 - RNA, 1401 nt, Artificial Sequence
  derived and/or modified sequence opt5 from neuraminidase__InfluenzaB__AGX20804
augcugcccagcaccauccagacacucacgcuguucauuaccuccggcggggugcuucugucucucuacgucagcgcccugcuuuccuaucugcucuacucugacauccugcugaaguuuagcccuacagagauuaccgcuccgacaaugucccucgauugcgccaacgcgucuaauguucaagcugugaacagaagcgccaccaaaggagugacauuccugcuucccgaaccugaguggaccuauccccggcuguccuguccuggcagcacguuucagaaggcccuccugaucucuccccaccgcuucggggaaaccaaaggaaauuccgcuccucuuauuaucagagagccguuuaucgccugcggccccaacgaauguaagcauuucgcucugacacacuacgccgcgcagccugggggauauuacaauggcacccggggcgaccgcaacaaacucagacaucugauuagcgucaagcuggggaagauccccacaguggaaaauucuauuuuucacauggccgcuugguccggaagcgccugccaugauggcaaagaguggaccuauaucgggguugacggaccugauaacgacgcucuccugaaggugaaauacggcgaggccuacacggauacauaucacucuuacgcgaauaagauucuucggacccaggaguccgccuguaacugcaucgggggaaauuguuaucugaugauuacagacggcagcgcuuccggcgucucugaaugccgcuuccucaaaaucagagaggggcggaucauuaaggagaucuuucccaccggacgcgugaagcacaccgaagaguguacaugcggcuucgccagcaacaaaacgauugaaugugcuugcagagauaauuccuacaccgccaagcggccguuuguuaaacugaacguggagacagacaccgccgaaauccgccuuaugugcacagauaccuaucuggacacgccuagacccgaugacgggagcauuacaggaccuugugagucuaauggcgacaagggguccggaggcaucaaaggcggguucguccaucaacggauggagagcaagaucggacgcugguacucuagaaccaugagcaaaaccgaacggaugggcauggggcucuaugugaaguacgauggagaccccugggcugauuccgacgcgcuggccuuuucuggcgugauggucagcaugaaggagcccgggugguacuccuucggcuucgaaauuaaagauaagaaaugcgacguuccuuguaucggaauugagauggugcacgauggcgggaaggaaacauggcauagcgcugccaccgccaucuauugccugaugggaucuggccagcuccugugggacacagugacgggggucgauauggcucuuuga

SEQ ID NO: 212558 - RNA, 1401 nt, Artificial Sequence; identical to SEQ ID NO: 211980
  derived and/or modified sequence opt5 from neuraminidase__InfluenzaB__AGX20815

SEQ ID NO: 212559 - RNA, 1401 nt, Artificial Sequence; identical to SEQ ID NO: 211980
  derived and/or modified sequence opt5 from neuraminidase__InfluenzaB__AGX20826

SEQ ID NO: 212560 - RNA, 1401 nt, Artificial Sequence; identical to SEQ ID NO: 211980
  derived and/or modified sequence opt5 from neuraminidase__InfluenzaB__AGX20837

SEQ ID NO: 212561 - RNA, 1401 nt, Artificial Sequence; identical to SEQ ID NO: 211980
  derived and/or modified sequence opt5 from neuraminidase__InfluenzaB__AGX20848

SEQ ID NO: 212562 - RNA, 1401 nt, Artificial Sequence
  derived and/or modified sequence opt5 from neuraminidase__InfluenzaB__AGX20870
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaaggguccggaggcaucaagggcggguucgugcaccagcggauggcuagcaaaaucggacgcugguacucuagaacaaugagcaagaccgagcggaaaggcauggggcucuaugucaaguacgacggagaacccuggaccgauuccgacgcgcuggccuuuagaggcgugauggugucuaugaaggagccugggugguacagcuucggcuucgaaauuaaagauaagaaaugcgacgucccguguaucggaauugagaugguucaugauggcgggaaggaaacauggcacuccgcugccaccgccaucuauugccugaugggaagcggccaacuccugugggacacagugacggggguggauauggcucuuuga

SEQ ID NO: 212563 - RNA, 1401 nt, Artificial Sequence
  derived and/or modified sequence opt5 from neuraminidase__InfluenzaB__AGX20881
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcaaccgcaauaaacucagacaccugaucagcgucaagcuggggaagauuccuaccguggagaacucuaucuuucauauggccgcuugguccggaagcgccugccacgacggcaaagaguggacauauauugggguugauggacccgacaauaacgcucuccugaagaucaaauacggcgaagccuacaccgauacguaucacucuuacgcgaauaacauucuucggacacaggaguccgccuguaauugcaucgggggaaacuguuaucugaugauuaccgacggcagcgcuuccggcgugucugaaugccgcuuccucaagaucagagaggggcggaucauuaaagagaucuuuccgacaggacgcgucaagcauaccgaagaguguaccugcggcuucgccagcaauaagacaauugaaugugcuugcagagauaacuccuacacggccaaacggccuuuugugaagcugaacguugagaccgacacagccgaaauccgccuuaugugcaccgauacauaucuggacacccccagaccugaugacgggagcauuacgggacccugugagucuaauggcgauaaaggguccggaggcaucaagggcggguucgugcaccagcggauggcuagcaaaaucggacgcugguacucuagaacaaugagcaagaccgagcggaaaggcauggggcucuaugucaaguacgacggagaccccuggaccgauuccgacgcgcuggccuuuagaggcgugauggugucuaugaaggaaccugggugguacagcuucggcuucgagauuaaagauaagaaaugcgacgucccguguaucggaauugaaaugguucaugauggcgggaaggagacauggcacuccgcugccaccgccaucuauugccugaugggaagcggccaacuccugugggacacagugacggggguggauauggcucuuuga

SEQ ID NO: 212564 - RNA, 1401 nt, Artificial Sequence
  derived and/or modified sequence opt5 from neuraminidase__InfluenzaB__AGX20892
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaagcuaagggaaauuccgccccucugaucauucgggagccguuuaucgcuugcggccccaacgaauguaaacauuucgcccucacccacuacgcggcccagccugggggauauuacaauggcacacgcggcgacagaaacaagcugcggcaucugaucagcgucaaacucgggaagauucccaccguggaaaauucuaucuuucacauggcugccugguccggaagcgcuugccaugauggcaaggaguggacauauauugggguugacggaccugauaacgacgcccugcuuaaagugaaguacggcgaggcguacaccgauacguaucacucuuacgccaauaaaauccugcgcacacaggaguccgcuuguaacugcauugggggaaauuguuaucucaugaucaccgacggcagcgccuccggcgucucugaaugcagauuccugaagauucgggaggggcgcaucaucaaagagauucuucccacaggaagagugaagcacaccgaagaguguaccugcggcuuugcuagcaacaagacaaucgaaugugccugccgggauaauuccuacacggccaaacgcccguucguuaagcugaacguggagaccgacacagcugaaauuagacucaugugcaccgauacauaucuggacaccccucggcccgaugacgggagcaucacgggaccuugugagucuaauggcgacaaaggguccggaggcauuaagggcggguuuguccaucaacgcauggagagcaaaaucggaagaugguacucucggacaaugagcaagaccgaaagaaugggcauggggcuguaugugaaauacgauggagaccccugggcggauuccgacgcccucgcuuucucuggcgugauggucagcaugaaggagcccgggugguacuccuuuggcuucgaaaucaaggauaaaaagugcgacguuccuuguauuggaaucgagauggugcacgauggcgggaaagaaaccuggcauagcgccgccacagcuauuuauugccugaugggaucuggccagcuucugugggacaccgugacaggggucgauauggcccucuga

SEQ ID NO: 212565 - RNA, 1401 nt, Artificial Sequence; identical to SEQ ID NO: 211980
  derived and/or modified sequence opt5 from neuraminidase__InfluenzaB__AGX20903

SEQ ID NO: 212566 - RNA, 1401 nt, Artificial Sequence; identical to SEQ ID NO: 211980
  derived and/or modified sequence opt5 from neuraminidase__InfluenzaB__AGX20914

SEQ ID NO: 212567 - RNA, 1401 nt, Artificial Sequence
  derived and/or modified sequence opt5 from neuraminidase__InfluenzaB__AGX20925
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauucaagaggggagaaucaucaaggagauuuuucccaccggacgggugaagcacaccgaagaguguacaugcggcuucgccagcaacaaaacgaucgaaugugcuugccgcgauaauuccuacaccgccaagagaccguuuguuaaacuuaacguggagacagacaccgccgaaauucggcugaugugcacagauaccuaucucgacacgccucgccccgaugacgggagcaucacaggaccuugugagucuaauggcgacaagggguccggaggcauuaaaggcggguucguccaucagagaauggagagcaagaucggacggugguacucucgcaccaugagcaaaaccgaaagaaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaacauggcauagcgcugccaccgccauuuauugccucaugggaucuggccagcugcuuugggacacagugacgggggucgauauggcucuguga

SEQ ID NO: 212568 - RNA, 1401 nt, Artificial Sequence
  derived and/or modified sequence opt5 from neuraminidase__InfluenzaB__AGX20936
augcugcccagcaccauccagacacucacgcuguuccuuaccuccggcggggugcugcucucucuguacgucagcgcccuucuguccuaucuccuguacucugacauucugccuaaguuuagcccgacagagaucaccgcucccacaaugucccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaacgaauguaagcauuucgcucugacacacuacgccgcgcagcccgggggauauuacaauggcacccggggcgaccgcaacaaacucagacaucugaucagcgucaagcuggggaagauuccuacaguggaaaauucuaucuuucacauggccgcuugguccggaagcgccugccaugauggcaaagaguggaccuauauugggguugacggacccgauaacgacgcucuccugaaggugaaauacggcgaggccuacacggauacauaucacucuuacgcgaauaagauccuucggacccaggaguccgccuguaacugcauugggggaaauuguuaucugaugaucacagacggcagcgcuuccggcgucucugaaugccgcuuccucaaaauuagagaggggcggaucaucaaggagauuuuuccgaccggacgcgugaagcacaccgaagaguguacaugcggcuucgccagcaacaaaacgaucgaaugugcuugcagagauaauuccuacaccgccaagcggccuuuuguuaaacugaacguggagacagacaccgccgaaauucgccuuaugugcacagauaccuaucuggacacgcccagaccugaugacgggagcaucacaggacccugugagucuaauggcgacaagggguccggaggcauuaaaggcggguucguccaucaacggauggagagcaagaucggacgcugguacucuagaaccaugagcaaaaccgaacggaugggcauggggcucuaugugaaguacgauggagaccccugggcugauuccgacgcgcugguguuuucuggcgucaugguuagcaugaaggagccugggugguacuccuucggcuucgaaaucaaagauaagaaaugcgacgugccguguauuggaaucgagauggugcacgauggcgggaaggaaacauggcauagcgccgcuaccgccauuuauugccugaugggaucuggccagcuccugugggacacagucacggggguggauauggcccuuuga

SEQ ID NO: 212569 - RNA, 1401 nt, Artificial Sequence; identical to SEQ ID NO: 211919
  derived and/or modified sequence opt5 from neuraminidase__InfluenzaB__AGX20947

SEQ ID NO: 212570 - RNA, 1401 nt, Artificial Sequence
  derived and/or modified sequence opt5 from neuraminidase__InfluenzaB__AGX20958
augcugcccagcaccauccagacacucacgcuguuccuuaccuccggcggggugcugcucucucuguacgucagcgcccuucuguccuaucuccuguacucugacauucugcucaaguuuagcccuacagagaucaccacaccgaccaugucccuggauugcacaaacgcuucuaauguucaagccgugaacagaagcgcgaccaaaggagugacguuccuucugcccgaaccugaguggaccuauccccggcucuccuguccuggcagcacauuucagaaggcucugcuuauuucuccccaccgcuucggggaaaccaaaggaaauuccgccccucugaucauuagagagccguuuaucgccugcggccccaacgaauguaagcauuucgcucucacacacuacgccgcucagccugggggauauuacaauggcacccggggcgaccgcaacaaacugagacaucugaucagcgucaagcucgggaagauucccacgguggaaaauucuaucuuucacauggccgcgugguccggaagcgccugccaugauggcaaagaguggacauauauugggguugacggaccugauaacgacgcucugcuuaaggugaaauacggcgaggccuacaccgauacauaucacucuuacgcuaauaagauccugcggacccaggaguccgccuguaacugcauugggggaaauuguuaucucaugaucaccgacggcagcgcguccggcgucucugaaugccgcuuccugaaaauucaagaggggagaaucaucaaggagauuuuucccacaggacgggugaagcacacggaagaguguaccugcggcuucgccagcaacaaaacaaucgaaugugcuugccgcgauaauuccuacaccgccaagagaccguuuguuaaacuuaacguggagacagacaccgcugaaauucggcugaugugcacggauacauaucucgacaccccucgccccgaugacgggagcaucaccggaccuugugagucuaauggcgacaagggguccggaggcauuaaaggcggguucguccaucagagaauggagagcaagaucggacggugguacucucgcacaaugagcaaaaccgaaagaaugggcauggggcuguaugugaaguacgauggagaccccugggccgauuccgacgcccuggcuuuuucuggcgugauggucagcaugaaggagcccgggugguacuccuucggcuucgaaaucaaagauaagaaaugcgacguuccuuguauuggaaucgagauggugcacgauggcgggaaggaaacauggcauagcgcggccacggcuauuuauugccucaugggaucuggccagcugcuuugggacaccgugacaggggucgauauggcccuguga

SEQ ID NO: 212571 - RNA, 1401 nt, Artificial Sequence; identical to SEQ ID NO: 212143
  derived and/or modified sequence opt5 from neuraminidase__InfluenzaB__AGX20969

SEQ ID NO: 212572 - RNA, 1401 nt, Artificial Sequence; identical to SEQ ID NO: 212556
  derived and/or modified sequence opt5 from neuraminidase__InfluenzaB__AGX20980

SEQ ID NO: 212573 - RNA, 1401 nt, Artificial Sequence
  derived and/or modified sequence opt5 from neuraminidase__InfluenzaB__AGX20991
augcugcccagcaccauccagacacucacgcuguuccuuaccuccggcggggugcugcucucucuguacgucagcgcccuucuguccuaucuccuguacucugacauucugccuaaguuuagcccgacagagaucaccgcucccacaaugucccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaacgaauguaagcauuucgcucugacacacuacgccgcgcagcccgggggauauuacaauggcacccggggcgaccgcaacaaacucagacaucugaucagcgucaagcuggggaagauuccuacaguggaaaauucuaucuuucacauggccgcuugguccggaagcgccugccaugauggcaaagaguggaccuauauugggguugacggacccgauaacgacgcucuccugaaggugaaauacggcgaggccuacacggauacauaucacucuuacgcgaauaagauccuucggacccaggaguccgccuguaacugcauugggggaaauuguuaucugaugaucacagacggcagcgcuuccggcgucucugaaugccgcuuccucaaaauuagaaaggggcggaucaucaaggagauuuuuccgaccggacgcgugaaacacaccgaggaauguacaugcggcuucgccagcaacaagacgaucgagugugcuugcagagauaauuccuacaccgccaaacggccuuuuguuaagcugaacguggaaacagacaccgccgagauucgccuuaugugcacagauaccuaucuggacacgcccagaccugaugacgggagcaucacaggacccugugaaucuaauggcgacaaaggguccggaggcauuaagggcggguucguccaucaacggauggagagcaaaaucggacgcugguacucuagaaccaugagcaagaccgagcggaugggcauggggcucuaugugaaguacgauggagaccccugggcugauuccgacgcgcugguguuuucuggcgucaugguuagcaugaaagaaccugggugguacuccuucggcuucgagaucaaggauaaaaagugcgacgugccguguauuggaaucgaaauggugcacgauggcgggaaagagacauggcauagcgccgcuaccgccauuuauugccugaugggaucuggccagcuccugugggacacagucacggggguggauauggcccuuuga

SEQ ID NO: 212574 - RNA, 1401 nt, Artificial Sequence; identical to SEQ ID NO: 211980
  derived and/or modified sequence opt5 from neuraminidase__InfluenzaB__AGX21002

SEQ ID NO: 212575 - RNA, 1401 nt, Artificial Sequence
  derived and/or modified sequence opt5 from neuraminidase__InfluenzaB__AGX21013
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacaaauaccuaucucgauacgccuagacccgacgaugggagcaucacaggaccuugugagucuaacggcgacaagggguccggaggcauuaaaggcggguucguccaucaacggauggagagcaagaucggacgcugguacucuagaaccaugagcaaaaccgaacggaugggcauggggcuguaugugaaguacgacggagaucccugggcugacuccgaugcgcuggccuuuucuggcgugauggucagcaugaaggagcccgggugguacuccuucggcuucgaaaucaaagacaagaaaugcgauguuccuuguauuggaaucgagauggugcacgacggcgggaaggaaacauggcauagcgcugccaccgccauuuauugccucaugggaucuggccagcugcuuugggauacagugacgggggucgacauggcucuguga

SEQ ID NO: 212576 - RNA, 1401 nt, Artificial Sequence
  derived and/or modified sequence opt5 from neuraminidase__InfluenzaB__AGX21024
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccuaaucgcuuuggggaaaccaaaggaaacuccgcuccgcugaucauuagagagcccuucaucgccugcggcccuaaugaauguaagcacuuugcucucacacauuacgccgcgcagcccgggggauauuacaacggcacccggggcgaccgcaauaaacugagacaccugaucagcgucaagcucgggaagauuccuacaguggagaacucuaucuuccauauggccgcuugguccggaagcgccugccacgauggcaaagaguggaccuauauugggguugacggacccgauaauaacgcucugcuuaaggugaaauacggcgaagccuacacggacacauaucauucuuacgcgaauaagauccugcggacccaggaguccgccuguaacugcauugggggaaauuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaacaaaacgaucgaaugugcuugcagagacaauuccuacaccgccaagcggccuuucguuaaacuuaacguggagacagauaccgccgaaguccgccugaugugcacagacaccuaucucgauacgcccagaccuaacgacgggagcauuacaggacccugugagucugauggcgacaagggguccggaggcaucaaaggcggguuugugcaccaacggauggagagcaagauuggacgcugguacucuagaaccaugagcaaaaccgaacggaugggcauggggcuguaugugaaguacgacggagaucccugggcugacuccgaugcgcugacauucucuggcgucaugguuagcaugaaggagccugggugguacuccuuuggcuucgaaaucaaagacaagaaaugcgaugugccguguaucggaauugagauggugcaugacggcgggaaggaaaccuggcacagcgccgcuacagccaucuauugccucaugggaucuggccagcugcuuugggauacggucaccgggguggacauggcccuguga

SEQ ID NO: 212577 - RNA, 1401 nt, Artificial Sequence; identical to SEQ ID NO: 211980
  derived and/or modified sequence opt5 from neuraminidase__InfluenzaB__AGX21035

SEQ ID NO: 212578 - RNA, 1401 nt, Artificial Sequence; identical to SEQ ID NO: 212143
  derived and/or modified sequence opt5 from neuraminidase__InfluenzaB__AGX21046

SEQ ID NO: 212579 - RNA, 1401 nt, Artificial Sequence; identical to SEQ ID NO: 212146
  derived and/or modified sequence opt5 from neuraminidase__InfluenzaB__AGX21057

SEQ ID NO: 212580 - RNA, 1401 nt, Artificial Sequence; identical to SEQ ID NO: 212564
  derived and/or modified sequence opt5 from neuraminidase__InfluenzaB__AGX21068

SEQ ID NO: 212581 - RNA, 1401 nt, Artificial Sequence
  derived and/or modified sequence opt5 from neuraminidase__InfluenzaB__AGX21079
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccuccaagauccugcggacacaggagagcgcuuguaacugcauugggggaaauuguuaucucaugaucaccgauggcuccgccucuggcgucagcgaaugccgcuuucugaaaauuagagaggggcggaucaucaaggagauuuucccgacaggacgcgugaagcacaccgaagaguguaccugcggcuuugcuuccaacaaaacaaucgaaugugccugcagagacaauagcuacacggccaagcggccuuucguuaaacuuaacguggagaccgauacagcugaaauucgccugaugugcaccgacacauaucucgauacccccagaccuaaugacgggucuaucacgggacccugugaguccgauggcgacaaggggagcggaggcauuaaaggcggguuuguccaucaacggauggagucuaagaucggacgcugguacagcagaacaauguccaaaaccgaacggaugggcauggggcuguaugugaaguacgacggagaucccugggcggacucugaugcccuggcuuucagcggcgugauggucuccaugaaggagccugggugguacagcuuuggcuucgaaaucaaagacaagaaaugcgauguuccguguauuggaaucgagauggugcacgacggcgggaaggaaaccuggcauucugccgccacagcuauuuauugccucaugggauccggccagcugcuuugggauaccgugacaggggucgacauggcccuguga

SEQ ID NO: 212582 - RNA, 1401 nt, Artificial Sequence; identical to SEQ ID NO: 212146
  derived and/or modified sequence opt5 from neuraminidase__InfluenzaB__AGX21088

SEQ ID NO: 212583 - RNA, 1401 nt, Artificial Sequence; identical to SEQ ID NO: 212146
  derived and/or modified sequence opt5 from neuraminidase__InfluenzaB__AGX21099

SEQ ID NO: 212584 - RNA, 1401 nt, Artificial Sequence
  derived and/or modified sequence opt5 from neuraminidase__InfluenzaB__AGX21110
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagauucgccaccaaaggagugacauuucuucugcccgaaccugaguggaccuauccccggcucagcuguccuggcuccacguuccagaaggcccugcuuauuagcccccaccgcuuuggggaaaccaaaggaaauucugcuccucugaucauuagagagccguucaucgccugcggccccaacgaauguaagcauuuugcucucacacacuacgccgcgcagccugggggauauuacaauggcacccggggcgaccgcaacaaacugagacaucugaucuccgucaagcucgggaagauucccacaguggagaauagcaucuuccacauggccgcuuggucuggauccgccugccaugauggcaaagaguggaccuauauugggguugacggaccugauaacgacgcucugcuuaaggugaaauacggcgaagccuacacggauacauaucacagcuacgcgaauaagauccugcggacccaggagucugccuguaacugcauugggggaaauuguuaucucaugaucacagacggcuccgcuagcggcgucuccgaaugccgcuuucugaaaauuagagaggggcggaucaucaaggagauuuuccccaccggacgcgugaagcacaccgaagaguguacaugcggcuuugccucuaacaaaacgaucgaaugugcuugcagagauaauagcuacaccgccaagcggccguucguuaaacuuaacguggagacagacaccgccgaaauucgccugaugugcacagauaccuaucucgacacgccuagacccgaugacggguccaucacaggaccuugugagagcaauggcgacaaggggucuggaggcauuaaaggcggguuuguccaucaacggauggaguccaagaucggacgcugguacagcagaaccaugucuaaaaccgaacggaugggcauggggcuguaugugaaguacgauggagaccccugggcugauagcgacgcgcuggccuucuccggcgugauggucucuaugaaggagcccgggugguacagcuucggcuuugaaaucaaagauaagaaaugcgacguuccuuguauuggaaucgagauggugcacgauggcgggaaggaaacauggcauuccgcugccaccgccauuuauugccucaugggaagcggccagcugcuuugggacacagugacgggggucgauauggcucuguga

SEQ ID NO: 212585 - RNA, 1401 nt, Artificial Sequence
  derived and/or modified sequence opt5 from neuraminidase__InfluenzaB__AGX21121
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaccaaggagaucuuucccaccggacgcgugaagcacacagaagaguguacgugcggcuucgccagcaacaaaaccauugaaugugcuugcagagauaauuccuacacagccaagcggccguuuguuaaacuuaacguggagaccgacacagccgaaauccgccugaugugcaccgauacguaucucgacacaccuagacccgaugacgggagcauuaccggaccuugugagucuaauggcgacaagggguccggaggcaucaaaggcggguucguccaucaacggauggagagcaagauuggacgcugguacucuagaaccaugagcaaaacagaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguaucggaauugagauggugcacgauggcgggaaggaaaccuggcauagcgcugccacagccaucuauugccucaugggaucuggccagcugcuuugggacacggugaccggggucgauauggcucuguga

SEQ ID NO: 212586 - RNA, 1401 nt, Artificial Sequence; identical to SEQ ID NO: 212143
  derived and/or modified sequence opt5 from neuraminidase__InfluenzaB__AGX21132

SEQ ID NO: 212587 - RNA, 1401 nt, Artificial Sequence; identical to SEQ ID NO: 211919
  derived and/or modified sequence opt5 from neuraminidase__InfluenzaB__AGX21143

SEQ ID NO: 212588 - RNA, 1401 nt, Artificial Sequence; identical to SEQ ID NO: 211980
  derived and/or modified sequence opt5 from neuraminidase__InfluenzaB__AGX21154

SEQ ID NO: 212589 - RNA, 1401 nt, Artificial Sequence
  derived and/or modified sequence opt5 from neuraminidase__InfluenzaB__AGX21165
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacauggagacagacaccgccgaaauucgccugaugugcacagauaccuaucucgacacgccuagacccgaugacgggagcaucacaggaccuugugagucuaauggcgacaagggguccggaggcauuaaaggcggguucgugcaucaacggauggagagcaagaucggacgcugguacucuagaaccaugagcaaaaccgaacggaugggcauggggcuguaugucaaguacgauggagaccccugggcugauuccgacgcgcuggccuuuucuggcgugauggugagcaugaaggagcccgggugguacuccuucggcuucgaaaucaaagauaagaaaugcgacgucccuuguauuggaaucgagaugguucacgauggcgggaaggaaacauggcauagcgcugccaccgccauuuauugccucaugggaucuggccagcugcuuugggacacagugacggggguggauauggcucuguga

SEQ ID NO: 212590 - RNA, 1401 nt, Artificial Sequence; identical to SEQ ID NO: 211980
  derived and/or modified sequence opt5 from neuraminidase__InfluenzaB__AGX21176

SEQ ID NO: 212591 - RNA, 1401 nt, Artificial Sequence
  derived and/or modified sequence opt5 from neuraminidase__InfluenzaB__AGX21187
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaauguguuugcagagacaacuccuacaccgcuaagcggccuuucgugaaacuuaaugucgagacagauaccgccgaagugcgccugaugugcacagacaccuaucucgauacgcccagaccuaacgacgggagcauuacaggacccugugagucugauggcgacaagggguccggaggcaucaaaggcggguuugugcaucaacggauggagagcaagauuggacgcugguacucuagaaccaugagcaaaaccgaacggaugggcauggggcuguaugucaaguacgacggagaucccugggccgacuccgaugcucugacauucucuggcguuauggugagcaugaaggagccugggugguacuccuuuggcuucgaaaucaaagacaagaaaugcgaugugccguguaucggaauugagaugguccacgacggcgggaaggaaaccuggcauagcgcggccacagcuaucuauugccucaugggaucuggccagcugcuuugggauacggugaccgggguugacauggcccuguga

SEQ ID NO: 212592 - RNA, 1401 nt, Artificial Sequence
  derived and/or modified sequence opt5 from neuraminidase__InfluenzaB__AGX21198
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcgaaccuaacgaguguaagcacuucgcucugacccauuacgccgcgcagcccggcggguauuacaauggaacacggggcgaccgcaacaaacucagacaccugaucagcgucaagcugggcaagauuccuaccguggaaaauucuaucuuucauauggccgcuugguccgggagcgccugccacgauggaaaagaguggacauauauuggcguugacgggcccgauaacaaugcucuccugaagaucaaauacggagaggccuacaccgacacguaucacucuuacgcgaacaauauucuucggacacaggaauccgccuguaacugcaucggcgggaauuguuaucugaugauuaccgauggaagcgcuuccggcgugucugagugccgcuuccucaagaucagagagggccggaucauuaaagaaaucuuuccgacagggcgcgucaagcauaccgaggaauguaccugcggauucgccagcaacaagacaauugagugugcuugcagagacaauuccuacacggccaaacggccuuuugugaagcugaacguugaaaccgauacagccgagauccgccuuaugugcaccgacacauaucuggauacccccagaccugacgauggcagcauuacggggcccugugagucuaacggagacaaaggcuccgggggaaucaagggcggcuucgugcaccagcggauggcuagcaaaaucgggcgcugguacucuagaacaaugagcaagaccgaacggaaaggaaugggccucuaugucaaguacgacggggaucccuggaccgacuccgaugcgcuggccuuuagaggagugauggugucuaugaaggagccuggcugguacagcuucggguucgaaauuaaagacaagaaaugcgaugucccguguaucggcauugagaugguucaugacggaggcaaggaaacauggcacuccgcugccaccgccaucuauugccugauggggagcggacaacuccugugggauacagugacgggcguggacauggcucuuuga

SEQ ID NO: 212593 - RNA, 1401 nt, Artificial Sequence; identical to SEQ ID NO: 211980
  derived and/or modified sequence opt5 from neuraminidase__InfluenzaB__AGX21209

SEQ ID NO: 212594 - RNA, 1401 nt, Artificial Sequence; identical to SEQ ID NO: 212143
  derived and/or modified sequence opt5 from neuraminidase__InfluenzaB__AGX21220

SEQ ID NO: 212595 - RNA, 1401 nt, Artificial Sequence
  derived and/or modified sequence opt5 from neuraminidase__InfluenzaB__AGX21231
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaauccgaguggaccuauccucggcucagcugucccggcucuacguuucagaaggcccugcuuauuuccccucaccgcuucggggaaaccaaaggaaauagcgcuccccugaucauuagagagccuuuuaucgccugcggcccgaacgaauguaagcauuucgcucucacacacuacgccgcgcagcccgggggauauuacaauggcacccggggcgaccgcaacaaacugagacaucugaucucugucaagcucgggaagauuccuacaguggaaaauuccaucuuucacauggccgcuuggagcggaucugccugccaugauggcaaagaguggaccuauauugggguugacggacccgauaacgacgcucugcuuaaggugaaauacggcgaggccuacacggauacauaucacuccuacgcgaauaagauccugcggacccaggagagcgccuguaacugcauugggggaaauuguuaucucaugaucacagacggcuccgcuucuggcgucagcgaaugccgcuuccugaaaauuagagaggggcggaucaucaaggagauuuuuccuaccggacgcgugaagcacaccgaagaguguacaugcggcuucgccuccaacaaaacgaucgaaugugcuugcagagauaauagcuacaccgccaagcggcccuuuguuaaacuuaacguggagacagacaccgccgaaauucgccugaugugcacagauaccuaucucgacacgccgagaccugaugacgggucuaucacaggacccugugaguccaauggcgacaaggggagcggaggcauuaaaggcggguucguccaucaacggauggagucuaagaucggacgcugguacagcagaaccauguccaaaaccgaacggaugggcauggggcuguaugugaaguacgauggagacccuugggcugauucugacgcgcuggccuuuagcggcgugauggucuccaugaaggagcccgggugguacagcuucggcuucgaaaucaaagauaagaaaugcgacguucccuguauuggaaucgagauggugcacgauggcgggaaggaaacauggcauucugcugccaccgccauuuauugccucaugggauccggccagcugcuuugggacacagugacgggggucgauauggcucuguga

SEQ ID NO: 212596 - RNA, 1401 nt, Artificial Sequence; identical to SEQ ID NO: 212146
  derived and/or modified sequence opt5 from neuraminidase__InfluenzaB__AGX21242

SEQ ID NO: 212597 - RNA, 1401 nt, Artificial Sequence; identical to SEQ ID NO: 211980
  derived and/or modified sequence opt5 from neuraminidase__InfluenzaB__AGX21253

SEQ ID NO: 212598 - RNA, 1401 nt, Artificial Sequence
  derived and/or modified sequence opt5 from neuraminidase__InfluenzaB__AGX21264
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaaauaaaggaaacuccgcuccucugaucauuagagagccguucaucgccugcggccccaaugaauguaagcauuuugcucucacacacuacgccgcgcagccugggggauauuacaacggcacccggggcgaccgcaauaaacugagacaucugaucagcgucaagcucgggaagauucccacaguggagaacucuaucuuccacauggccgcuugguccggaagcgccugccaugauggcaaagaguggaccuauauugggguugacggaccugauaauaacgcucugcuuaaggugaaauacggcgaagccuacacggacacauaucacucuuacgcgaauaagauccugcggacccaggaguccgccuguaacugcauugggggaaauuguuaucucaugaucacagauggcagcgcuuccggcgucucugaaugccgcuuucugaaaauuagagaggggcggaucaucaaggagauuuuccccaccggacgcgugaagcacaccgaagaguguacaugcggcuuugccagcaacaaaacgaucgaaugugcuugcagagacaauuccuacaccgccaagcggccguucguuaaacuuaacguggagacagauaccgccgaaauucgccugaugugcacagacaccuaucucgauacgccuagacccaacgacgggagcaucacaggaccuugugagucugauggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcuggccuucucuggcgugauggucagcaugaaggagcccuccugguacagcuuuggguucgaaaucaaagacaagaaaugcgauguuccuuguauuggcaucgagauggugcacgacggaggcaaggaaacauggcauucugcugccaccgccauuuauugccucaugggguccggacagcugcuuugggauacagugacgggcgucgacauggcucuguga

SEQ ID NO: 212599 - RNA, 1401 nt, Artificial Sequence; identical to SEQ ID NO: 211919
  derived and/or modified sequence opt5 from neuraminidase__InfluenzaB__AGX21275

SEQ ID NO: 212600 - RNA, 1401 nt, Artificial Sequence; identical to SEQ ID NO: 211980
  derived and/or modified sequence opt5 from neuraminidase__InfluenzaB__AGX21286

SEQ ID NO: 212601 - RNA, 1401 nt, Artificial Sequence
  derived and/or modified sequence opt5 from neuraminidase__InfluenzaB__AGX21297
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgacuggaccuauccucggcucuccugucccggcagcacguuccagaaggcccugcuuauuucuccucaccgcuuuggggagaccaaaggaaauuccgcuccgcugaucauuagagaacccuucaucgccugcggcccuaacgaguguaagcauuuugcucucacacacuacgccgcgcagcccgggggauauuacaauggcacccggggcgaucgcaacaaacugagacaucugaucagcgucaagcucgggaagauuccuacaguggaaaauucuaucuuccacauggccgcuugguccggaagcgccugccaugacggcaaagaguggaccuauauugggguugauggacccgacaacaaugcucugcuuaaggugaaauacggcgaggccuacacggauacauaucacucuuacgcgaacaagauccugcggacccaggaauccgccuguaauugcauugggggaaacuguuaucucaugaucacagacggcagcgcuuccggcgucucugagugccgcuuucugaaaauuagagaagggcggaucaucaaggagauuuucccgaccggacgcgugaagcacaccgaggaauguacaugcggcuuugccagcaauaaaacgaucgagugugcuugcagagauaacuccuacaccgccaagcggccuuucguuaaacuuaauguggaaacagacaccgccgagguccgccugaugugcacagauaccuaucucgacacgcccagaccuaacgaugggagcauuacaggacccugugaaucugacggcgacaagggguccggaggcaucaaaggcggguuugugcaucaacggauggagagcaagauuggacgcugguacucuagaaccaugagcaaaaccgagcggaugggcauggggcuguaugugaaguacgauggagaccccugggcugauuccgacgcgcugacauucucuggcgucaugguuagcaugaaggaaccugggugguacuccuuuggcuucgagaucaaagauaagaaaugcgacgugccguguaucggaauugaaauggugcacgauggcgggaaggagaccuggcauagcgccgcuacagccaucuauugccucaugggaucuggccagcugcuuugggacacggucaccgggguggauauggcccuguga

SEQ ID NO: 212602 - RNA, 1401 nt, Artificial Sequence
  derived and/or modified sequence opt5 from neuraminidase__InfluenzaB__AGX21308
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaaggguccggaggcaucaagggcggguucgugcaccagcggauggcuagcaaaaucggacgcugguacucuagaacaaugagcaagaccgagcggaaaggcauggggcucuaugucaaguacgacggagaucccuggaccgacuccgaugcgcuggcccugagaggcgugauggugucuaugaaggaaccugggugguacagcuuuggcuucgagauuaaagacaagaaaugcgaugucccguguaucggaauugaaaugguucaugacggcgggaaggagacauggcacuccgcugccaccgccaucuauugccucaugggaagcggccaacugcuuugggauacagugacggggguggacauggcucuguga

SEQ ID NO: 212603 - RNA, 1401 nt, Artificial Sequence; identical to SEQ ID NO: 211924
  derived and/or modified sequence opt5 from neuraminidase__InfluenzaB__AGX21319

SEQ ID NO: 212604 - RNA, 1401 nt, Artificial Sequence; identical to SEQ ID NO: 211919
  derived and/or modified sequence opt5 from neuraminidase__InfluenzaB__AGX21330

SEQ ID NO: 212605 - RNA, 1401 nt, Artificial Sequence; identical to SEQ ID NO: 211919
  derived and/or modified sequence opt5 from neuraminidase__InfluenzaB__AGX21341

SEQ ID NO: 212606 - RNA, 1401 nt, Artificial Sequence; identical to SEQ ID NO: 212146
  derived and/or modified sequence opt5 from neuraminidase__InfluenzaB__AGX21352

SEQ ID NO: 212607 - RNA, 1401 nt, Artificial Sequence
  derived and/or modified sequence opt5 from neuraminidase__InfluenzaB__AGX21363
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuucccaccgcuuuggggaaaccaaaggaaauagcgcuccucugaucauuagagagccguucgucgccugcggccccaacgaauguaagcauuuugcucucacacacuacgccgcgcagccugggggauauuacaauggcacccggggcgaccgcaacaaacugagacaucugaucucugugaagcucgggaagauccccacaguugaaaauuccauuuuccacauggccgcuuggagcggaucugccugccaugauggcaaagaguggaccuauaucgggguggacggaccugauaacaaugcucugcuuaaggucaaauacggcgaggccuacacggacacauaucacuccuacgcgaacaagauucugcggacccaggagagcgccuguaauugcaucgggggaaacuguuaucucaugauuacagauggcuccgcuucuggcgugagcgaaugccgcuuucugaaaaucagagaggggcggauuaucaaggagaucuuccccaccggacgcguuaagcacaccgaagaguguacaugcggcuuugccuccaauaaaacgauugaaugugcuugcagagacaacagcuacaccgccaagcggccguucgugaaacuuaaugucgagacagauaccgccgaaauccgccugaugugcacagacaccuaucucgauacgccuagacccaacgacgggucuauuacaggaccuugugaguccgauggcgacaaggggagcggaggcaucaaaggcggguuugugcaucaacggauggagucuaagauuggacgcugguacagcagaaccauguccaaaaccgaacggaugggcauggggcuguaugugaaguacgacggagaucccugggcugacucugaugcgcuggccuucagcggcgucaugguuuccaugaaggagcccgggugguacagcuuuggcuucgaaaucaaagacaagaaaugcgaugugccuuguaucggaauugagauggugcacgacggcgggaaggaaacauggcauucugcugccaccgccaucuauugccucaugggauccggccagcugcuuugggauacagucacggggguggacauggcucuguga

SEQ ID NO: 212608 - RNA, 1401 nt, Artificial Sequence; identical to SEQ ID NO: 211919
  derived and/or modified sequence opt5 from neuraminidase__InfluenzaB__AGX21374

SEQ ID NO: 212609 - RNA, 1401 nt, Artificial Sequence; identical to SEQ ID NO: 211980
  derived and/or modified sequence opt5 from neuraminidase__InfluenzaB__AGX21385

SEQ ID NO: 212610 - RNA, 1401 nt, Artificial Sequence; identical to SEQ ID NO: 211980
  derived and/or modified sequence opt5 from neuraminidase__InfluenzaB__AGX21396

SEQ ID NO: 212611 - RNA, 1401 nt, Artificial Sequence; identical to SEQ ID NO: 211919
  derived and/or modified sequence opt5 from neuraminidase__InfluenzaB__AGX21407

SEQ ID NO: 212612 - RNA, 1401 nt, Artificial Sequence; identical to SEQ ID NO: 211919
  derived and/or modified sequence opt5 from neuraminidase__InfluenzaB__AGX21418

SEQ ID NO: 212613 - RNA, 1401 nt, Artificial Sequence
  derived and/or modified sequence opt5 from neuraminidase__InfluenzaB__AGX21429
augcugcccagcaccauccagacacucacgcuguuccuuaccuccggcggggugcugcucucucuguacgucagcgcccuucuguccuaucuccugcacucugacauucugcucaaguuuagcccuacagagaucaccgcuccgacaaugucccuggauugcgccaacgcgucuaauguucaagcugugaacagaagcgugaccaaaggagucacauuccuucugcccgaaccugaguggaccuacccccggcucuccuguccuggcagcacguuucagaaggcccugcuuauuucuccccaucgcuucggggaaaccaaaggaaauuccgccccucugaucauuagagagccguuuaucgcuugcggccccaacgaauguaagcacuucgcccucacacauuaugcugcccagccugggggauacuauaauggcacccggggcgaccgcaacaaacugagacaccugaucagcgugaagcucgggaagauucccacaguugaaaauucuaucuuucauauggcggccugguccggaagcgcuugccacgauggcaaagaguggaccuacauugggguggacggaccugauaacgacgcccugcuuaaggucaaauauggcgaggcuuacacggauacauaccacucuuaugccaauaagauccugcggacccaggaguccgcguguaacugcauugggggaaauuguuaccucaugaucacagacggcagcgccuccggcgugucugaaugccgcuuccugaaaauuagagaggggcggaucaucaaggagauuuuucccaccggacgcguuaagcauaccgaagaguguacaugcggcuucgcuagcaacaaaacgaucgaaugugccugcagagauaauuccuauaccgcuaagcggccguuugugaaacuuaacgucgagacagacaccgccgaaauucgccugaugugcacagauaccuaccucgacacgccuagacccgaugacgggagcaucacaggaccuugugagucuaauggcgacaagggguccggaggcauuaaaggcggguucgugcaccaacggauggagagcaagaucggacgcugguauucuagaaccaugagcaaaaccgaacggaugggcauggggcuguacgugaaguaugauggagaccccugggccgauuccgacgcucuggcguuuucuggcgucaugguuagcaugaaggagcccgggugguacuccuucggcuucgaaaucaaagauaagaaaugcgacgugccuuguauuggaaucgagauggugcaugauggcgggaaggaaacauggcacagcgccgcuaccgccauuuacugccucaugggaucuggccagcugcuuugggacacagucacggggguggauauggcccuguga

SEQ ID NO: 212614 - RNA, 1401 nt, Artificial Sequence; identical to SEQ ID NO: 211980
  derived and/or modified sequence opt5 from neuraminidase__InfluenzaB__AGX21440

SEQ ID NO: 212615 - RNA, 1401 nt, Artificial Sequence; identical to SEQ ID NO: 211980
  derived and/or modified sequence opt5 from neuraminidase__InfluenzaB__AGX21451

SEQ ID NO: 212616 - RNA, 1401 nt, Artificial Sequence; identical to SEQ ID NO: 212564
  derived and/or modified sequence opt5 from neuraminidase__InfluenzaB__AGX21462

SEQ ID NO: 212617 - RNA, 1401 nt, Artificial Sequence
  derived and/or modified sequence opt5 from neuraminidase__InfluenzaB__AGX21473
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaagcuaagggaaauuccgccccucugaucauucgggagccguuuaucgcuugcggccccaacgaauguaaacauuucgcccucacccacuacgcggcccagccugggggauauuacaauggcacacgcggcgacagaaacaagcugcggcaucugaucagcgucaaacucgggaagauucccaccguggaaaauucuaucuuucacauggcugccugguccggaagcgcuugccaugauggcaaggaguggacauauauugggguugacggaccugauaacgacgcccugcuuaaagugaaguacggcgaggcguacaccgauacguaucacucuuacgccaauaaaauccugcgcacacaggaguccgcuuguaacugcauugggggaaauuguuaucucaugaucaccgacggcagcgccuccggcgucucugaaugcagauuccugaagauucgggaggggcgcaucaucaaagagauucuucccacaggaagagugaagcacaccgaagaguguaccugcggcuuugcuagcaacaagacaaucgaaugugccugccgggauaauuccuacacggccaaacgcccguucguuaagcugaacguggagaccgacacagcugaaauuagacucaugugcaccgauacauaucuggacaccccucggcccgaugacgggagcaucacgggaccuugugagucuaauggcgacaaaggguccggaggcauuaagggcggguuuguccaucaacgcauggagagcaaaaucggaagaugguacucucggacaaugagcaagaccgaaagaaugggcauggggcuguaugugaaauacgauggagaccccugggcggauuccgacgcccucguguucucuggcgucaugguuagcaugaaggagcccgggugguacuccuuuggcuucgaaaucaaggauaaaaagugcgacgugccuuguauuggaaucgagauggugcacgauggcgggaaagaaaccuggcauagcgcugccacagccauuuauugccugaugggaucuggccagcuucugugggacaccgucacagggguggauauggcucucuga

SEQ ID NO: 212618 - RNA, 1401 nt, Artificial Sequence; identical to SEQ ID NO: 211924
  derived and/or modified sequence opt5 from neuraminidase__InfluenzaB__AGX21484

SEQ ID NO: 212619 - RNA, 1401 nt, Artificial Sequence; identical to SEQ ID NO: 211980
  derived and/or modified sequence opt5 from neuraminidase__InfluenzaB__AGX21495

SEQ ID NO: 212620 - RNA, 1401 nt, Artificial Sequence; identical to SEQ ID NO: 211980
  derived and/or modified sequence opt5 from neuraminidase__InfluenzaB__AGX21506

SEQ ID NO: 212621 - RNA, 1401 nt, Artificial Sequence
  derived and/or modified sequence opt5 from neuraminidase__InfluenzaB__AGX21517
augcugcccagcaccauccagacacucacgcuguuccuuaccuccggcggggugcugcucucucuguacgucagcgcccuucuguccuaucuccuguacucuaacauucugcucaaguuuagcccuacagagaucaccgcuccgacaaugucccuggacugcgccaaugcgucuaacguucaagcugugaauagaagcgccaccaaaggagugacauuccuucugcccgaaccugaguggaccuauccccggcucuccuguccuggcagcacguuucagaaggcccugcuuauuucuccccaccgcuucggggaaaccaaaggaaacuccgcuccucugaucauuagagagccguuuaucgccugcggccccaaugaauguaagcauuucgcucucacacacuacgccgcgcagccugggggauauuacaacggcacccggggcgaucgcaauaaacugagacaucugaucagcgucaagcucgggaagauucccacaguggagaacucuaucuuucacauggccgcuugguccggaagcgccugccaugacggcaaagaguggaccuauauugggguugauggaccugacaaugaugcucugcuuaaggugaaauacggcgaagccuacacggacacauaucacucuuacgcgaacaagauccugcggacccaggaguccgccuguaauugcauugggggaaacuguuaucucaugaucacagauggcagcgcuuccggcgucucugaaugccgcuuccugaaaauuagagaggggcggaucaucaaggagauuuuucccaccggacgcgugaagcacaccgaagaguguacaugcggcuucgccagcaauaaaacgaucgaaugugcuugcagagacaacuccuacaccgccaagcggccguuuguuaaacuuaauguggagacagauaccgccgaaauucgccugaugugcacagacaccuaucucgauacgccuagacccgacgaugggagcaucacaggaccuugugagucuaacggcgacaagggguccggaggcauuaaaggcggguucguccaucaacggauggagagcaagaucggacgcugguacucuagaaccaugagcaaaaccgaacggaugggcauggggcuguaugugaaguacgacggagaucccugggcugacuccgaugcgcuggccuuuucuggcgugauggucagcaugaaggagcccgggugguacuccuucggcuucgaaaucaaagacaagaaaugcgauguuccuuguauuggaaucgagauggugcacgacggcgggaaggaaacauggcauagcgcugccaccgccauuuauugccucaugggaucuggccagcugcuuugggauacagugacgggggucgacauggcucuguga

SEQ ID NO: 212622 - RNA, 1401 nt, Artificial Sequence
  derived and/or modified sequence opt5 from neuraminidase__InfluenzaB__AGX21528
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaguccgccugaugugcacagacaccuaucucgauacgcccagaccuaacgacgggagcauuacaggacccugugagucugauggcgacaagggguccggaggcaucaaaggcggguuugugcaucaacggauggagagcaagauuggacgcugguacucuagaaccaugagcaaaaccgaacggaugggcauggggcuguaugugaaguacgacggagaucccugggcugacuccgaugcgcugacauucucuggcgucaugguuagcaugaaggagccugggugguacuccuuuggcuucgaaaucaaagacaagaaaugcgaugugccguguaucggaauugagauggugcacgacagcggcaaggaaaccuggcauucugccgcuacagccaucuauugccucaugggguccggacagcugcuuugggauacggucaccggcguggacauggcccuguga

SEQ ID NO: 212623 - RNA, 1401 nt, Artificial Sequence; identical to SEQ ID NO: 211980
  derived and/or modified sequence opt5 from neuraminidase__InfluenzaB__AGX21539

SEQ ID NO: 212624 - RNA, 1401 nt, Artificial Sequence
  derived and/or modified sequence opt5 from neuraminidase__InfluenzaB__AGX21550
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccggccggacgcgugaagcacaccgaagaguguaccugcggcuuugcuagcaauaaaacaaucgaaugugccugcagagacaacuccuacacggccaagcggccuuucguuaaacuuaauguggagaccgauacagcugaaguccgccugaugugcaccgacacauaucucgauacccccagaccuaacgacgggagcauuacgggacccugugagucugauggcgacaagggguccggaggcaucaaaggcggguuugugcaucaacggauggagagcaagauuggacgcugguacucuagaacaaugagcaaaaccgaacggaugggcauggggcuguaugugaaguacgacggagaucccugggcggacuccgaugcccugaccuucucuggcgucaugguuagcaugaaggagccugggugguacuccuuuggcuucgaaaucaaagacaagaaaugcgaugugccguguaucggaauugagauggugcacgacggcgggaaggaaacauggcauagcgcugccaccgccaucuauugccucaugggaucuggccagcugcuuugggauacagucacggggguggacauggcucuguga

SEQ ID NO: 212625 - RNA, 1401 nt, Artificial Sequence
  derived and/or modified sequence opt5 from neuraminidase__InfluenzaB__AGX21561
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaagugagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaagugcgccugaugugcacagacaccuaucucgauacgcccagaccuaacgacgggagcaucacaggacccugugagucugauggcgacaagggguccggaggcauuaaaggcggguuugugcaucaacggauggagagcaagaucggacgcugguacucuagaaccaugagcaaaaccgaacggaugggcauggggcuguaugucaaguacgacggagaucccugggcugacuccgaugcgcugacauucucuggcguuauggugagcaugaaggagccugggugguacuccuuuggcuucgaaauuaaagacaagaaaugcgaugugccguguaucggaaucgagaugguccacgacggcgggaaggaaaccuggcauagcgccgcuacagccauuuauugccucaugggaucuggccagcugcuuugggauacggugaccgggguugacauggcccuguga

SEQ ID NO: 212626 - RNA, 1401 nt, Artificial Sequence; identical to SEQ ID NO: 211924
  derived and/or modified sequence opt5 from neuraminidase__InfluenzaB__AGX21572

SEQ ID NO: 212627 - RNA, 1401 nt, Artificial Sequence
  derived and/or modified sequence opt5 from neuraminidase__InfluenzaB__AGX21583
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaagcuaagggaaauuccgccccucugaucauucgggagccguuuaucgcuugcggccccaacgaauguaaacauuucgcccucacccacuacgcggcccagccugggggauauuacaauggcacacgcggcgacagaaacaagcugcggcaucugaucagcgucaaacucgggaagauucccaccguggaaaauucuaucuuucacauggcugccugguccggaagcgcuugccaugauggcaaggaguggacauauauugggguugacggaccugauaacgacgcccugcuuaaagugaaguacggcgaggcguacaccgauacguaucacucuuacgccaauaaaauccugcgcacacaggaguccgcuuguaacugcauugggggaaauuguuaucucaugaucaccgacggcagcgccuccggcgucucugaaugcagauuccugaagauucgggaggggcgcaucaucaaagagauucuucccacaggaagagugaagcacaccgaagaguguaccugcggcuuugcuagcaacaagacaaucgaaugugccugccgggauaauuccuacacggccaaacgcccguucguuaagcugaacguggagaccgacacagcugaaauuagacucaugugcaccgauacauaucuggacaccccucggcccgaugacgggagcaucacgggaccuugugagucuaauggcgacaaaggguccggaggcauuaagggcggguuuguccaucaacgcauggagagcaaaaucggaagaugguacucucggacaaugagcaagaccgaaagaaugggcauggagcuguaugugaaauacgauggggaccccugggcggauuccgacgcccucgcuuucucuggagugauggucagcaugaaggaacccggcugguacuccuuuggguucgagaucaaggauaaaaagugcgacguuccuuguauuggcaucgaaauggugcacgauggaggcaaagagaccuggcauagcgccgccacagcuauuuauugccugauggggucuggacagcuucugugggacaccgugacaggcgucgauauggcccucuga

SEQ ID NO: 212628 - RNA, 1401 nt, Artificial Sequence; identical to SEQ ID NO: 211924
  derived and/or modified sequence opt5 from neuraminidase__InfluenzaB__AGX21594

SEQ ID NO: 212629 - RNA, 1401 nt, Artificial Sequence; identical to SEQ ID NO: 212146
  derived and/or modified sequence opt5 from neuraminidase__InfluenzaB__AGX21605

SEQ ID NO: 212630 - RNA, 1401 nt, Artificial Sequence
  derived and/or modified sequence opt5 from neuraminidase__InfluenzaB__AGX21615
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuauuucuccccaccgcuuuggggaaaauaaaggaaacuccgcuccucugaucauuagagagccguucaucgccugcggccccaaugaauguaagcauuuugcucucacacacuacgccgcgcagccugggggauauuacaacggcacccggggcgaccgcaauaaacugagacaucugaucagcgucaagcucgggaagauucccacaguggagaacucuaucuuccacauggccgcuugguccggaagcgccugccaugauggcaaagaguggaccuauauugggguugacggaccugauaauaacgcucugcuuaaggugaaauacggcgaagccuacacggacacauaucacucuuacgcgaauaagauccugcggacccaggaguccgccuguaacugcauugggggaaauuguuaucucaugaucacagauggcagcgcuuccggcgucucugaaugccgcuuucugaaaauuagagaggggcggaucaucaaggagauuuuccccaccggacgcgugaagcacaccgaagaguguacaugcggcuuugccagcaacaaaacgaucgaaugugcuugcagagacaauuccuacaccgccaagcggccguucguuaaacuuaacguggagacagauaccgccgaaauucgccugaugugcacagacaccuaucucgauacgccuagacccaacgacgggagcaucacaggaccuugugagucugauggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcuggccuucucuggcgugauggucagcaugaaggagcccgggugguacuccuuuggcuucgaaaucaaagacaagaaaugcgauguuccuuguauuggaaucgagauggugcacgacggcgggaaggaaacauggcauagcgcugccaccgccauuuauugccucaugggaucuggccagcugcuuugggauacagugacgggggucgacauggcucuguga

SEQ ID NO: 212631 - RNA, 1401 nt, Artificial Sequence; identical to SEQ ID NO: 211980
  derived and/or modified sequence opt5 from neuraminidase__InfluenzaB__AGX21626

SEQ ID NO: 212632 - RNA, 1401 nt, Artificial Sequence; identical to SEQ ID NO: 211980
  derived and/or modified sequence opt5 from neuraminidase__InfluenzaB__AGX21637

SEQ ID NO: 212633 - RNA, 1401 nt, Artificial Sequence; identical to SEQ ID NO: 211980
  derived and/or modified sequence opt5 from neuraminidase__InfluenzaB__AGX21648

SEQ ID NO: 212634 - RNA, 1401 nt, Artificial Sequence
  derived and/or modified sequence opt5 from neuraminidase__InfluenzaB__AGX21659
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucuggucagcgugaagcucgggaagauccccacaguugaaaauucuauuuuucacauggccgcuugguccggaagcgccugccaugauggcaaagaguggaccuauaucgggguggacggaccugauaacgacgcucugcuuaaggucaaauacggcgaggccuacacggauacauaucacucuuacgcgaauaagauucugcggacccaggaguccgccuguaacugcaucgggggaaauuguuaucucaugauuacagacggcagcgcuuccggcgugucugaaugccgcuuccugaaaaucagagaggggcggauuaucaaggagaucuuucccaccggacgcguuaagcacaccgaagaguguacaugcggcuucgccagcaacaaaacgauugaaugugcuugcagagauaauuccuacaccgccaagcggccguuugugaaacuuaacgucgagacagacaccgccgaaauccgccugaugugcacagauaccuaucucgacacgccuagacccgaugacgggagcauuacaggaccuugugagucuaauggcgacaagggguccggaggcaucaaaggcggguucgugcaucaacggauggagagcaagauuggacgcugguacucuagaaccaugagcaaaaccgaacggaugggcauggggcuguaugugaaguacggaggcgaucccugggcugacuccgaugcgcuggccuuuucuggggucaugguuagcaugaaggagcccggcugguacuccuucggauucgaaaucaaagacaagaaaugcgaugugccuuguaucggcauugagauggugcacgacgggggaaaggaaacauggcauagcgcugccaccgccaucuauugccucaugggcucugggcagcugcuuugggauacagucacgggaguggacauggcucuguga

SEQ ID NO: 212635 - RNA, 1401 nt, Artificial Sequence
  derived and/or modified sequence opt5 from neuraminidase__InfluenzaB__AGX21670
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaacagagauggugcacgauggcgggaaggaaaccuggcauagcgcugccacagccaucuauugccucaugggaucuggccagcugcuuugggacacggugaccggggucgauauggcucuguga

SEQ ID NO: 212636 - RNA, 1401 nt, Artificial Sequence
  derived and/or modified sequence opt5 from neuraminidase__InfluenzaB__AGX21681
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaagggaauggaggcaucaagggcggguucgugcaccagcggauggcuuccaaaaucggacgcugguacagcagaacaaugucuaagaccgagcggaaaggcauggggcucuaugucaaguacgacggagaucccuggaccgacagcgaugcgcuggccuuuagaggcgugaugguguccaugaaggaaccugggugguacucuuucggcuucgagauuaaagacaagaaaugcgaugucccguguaucggaauugaaaugguucaugacggcgggaaggagacauggcacagcgcugccaccgccaucuauugccugaugggauccggccaacuccugugggauacagugacggggguggacauggcucuuuga

SEQ ID NO: 212637 - RNA, 1401 nt, Artificial Sequence; identical to SEQ ID NO: 211919
  derived and/or modified sequence opt5 from neuraminidase__InfluenzaB__AGX21692

SEQ ID NO: 212638 - RNA, 1401 nt, Artificial Sequence; identical to SEQ ID NO: 212146
  derived and/or modified sequence opt5 from neuraminidase__InfluenzaB__AGX21703

SEQ ID NO: 212639 - RNA, 1401 nt, Artificial Sequence
  derived and/or modified sequence opt5 from neuraminidase__InfluenzaB__AGX21714
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggacugacccuucugcucccugaacccgaguggacauauccucggcuguccugucccggcagcaccuuccagaaggcccuucugauuucuccucaccgcuuuggggaaacgaaaggaaauuccgcuccgcucaucauuagagagcccuucaucgcuugcggcccuaacgaauguaagcauuuugcccugacccacuacgcggcccagcccgggggauauuacaauggcacacggggcgaccgcaacaaacugagacaucucaucagcgugaagcuggggaagauuccuaccgucgaaaauucuaucuuccacauggcugccugguccggaagcgcuugccaugauggcaaagaguggacauauauugggguggacggacccgauaacaaugcccuucugaagguuaaauacggcgaggcguacaccgacacguaucacucuuacgccaacaagauccuccggacacaggaguccgcuuguaauugcauugggggaaacuguuaucugaugaucaccgauggcagcgccuccggcgugucugaaugccgcuuucuuaaaauuagagaggggcggaucaucaaggagauuuucccgacaggacgcgucaagcacaccgaagaguguaccugcggcuuugcuagcaauaaaacaaucgaaugugccugcagagacaacuccuacacggccaagcggccuuucgugaaacugaauguugagaccgauacagcugaaauucgccucaugugcaccgacacauaucuggauacccccagaccuaacgacgggagcaucacgggacccugugagucugauggcgacaagggguccggaggcauuaaaggcggguuugugcaucaacggauggagagcaagaucggacgcugguacucuagaacaaugagcaaaaccgaacggaugggcauggggcuguaugucaaguacgacggagaucccugggcggacuccgaugcccucgcuuucucuggcgugauggugagcaugaaggagccugggugguacuccuuuggcuucgaaaucaaagacaagaaaugcgaugucccguguauuggaaucgagaugguucacgacggcgggaaggaaaccuggcauagcgccgccacagcuauuuauugccugaugggaucuggccagcuucugugggauaccgugacagggguggacauggcccucuga

SEQ ID NO: 212640 - RNA, 1401 nt, Artificial Sequence
  derived and/or modified sequence opt5 from neuraminidase__InfluenzaB__AGX21725
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaacgcgcccuccugauuucuccucauagauucggggaaacgaagggaaauuccgcuccgcuuaucauucgggagcccuuuaucgccugcggcccuaacgaauguaaacacuucgcucugacccauuacgccgcgcagcccgggggauauuacaauggcacacgcggcgacagaaacaagcuccggcaccugaucagcgucaaacuggggaagauuccuaccguggaaaauucuaucuuucauauggccgcuugguccggaagcgccugccacgauggcaaggaguggacauauauugggguugacggacccgauaacaaugcucuccugaaaaucaaguacggcgaggccuacaccgacacguaucacucuuacgcgaacaauauucuucgcacacaggaguccgccuguaacugcaucgggggaaauuguuaucugaugauuaccgauggcagcgcuuccggcgugucugaaugcagauuccucaaaauccgggaggggcgcaucauuaaggagaucuuuccgacaggaagagucaaacauaccgaagaguguaccugcggcuucgccagcaacaagacaauugaaugugcuugccgggacaauuccuacacggccaagcgcccuuuugugaaacugaacguugagaccgauacagccgaaaucagacuuaugugcaccgacacauaucuggauacgccccggccugacgaugggagcauuaccggacccugugagucuaacggcgacaagggguccggaggcaucaaaggcggguucgugcaccagcgcauggcuagcaagaucggaagaugguacucucggacaaugagcaaaaccgagagaaagggcauggggcucuaugucaaauacgacggagaucccuggaccgacuccgaugcgcuggccuuucgcggcgugauggugucuaugaaggaaccugggugguacagcuucggcuucgagauuaaggacaaaaagugcgaugucccguguaucggaauugaaaugguucaugacggcgggaaagagacauggcacuccgcugccaccgccaucuauugccugaugggaagcggccaacuccugugggauacagugacggggguggacauggcucuuuga

SEQ ID NO: 212641 - RNA, 1401 nt, Artificial Sequence
  derived and/or modified sequence opt5 from neuraminidase__InfluenzaB__AGX21747
augcugcccagcaccauccagacacucacgcuguuccuuaccuccggcggggugcugcucucucuguacgucagcgccucccuuucuuaucugcucuacagcgacauucugcugaagguuucccaaacagagaucaccgcuccuacaaugccgcucgauugcgccaacgcgucuaaugugcaggcugugaacagaagcgccaccaaaggagucacacugcuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaaggaauguaaacauuucgcucucacacacuacgccgcgcagccugggggauauuacaacggcacccgggaggaccgcaauaagcugagacaucugaucagcgugaagcucggcaaaauucccacaguugagaacucuaucuuucacauggccgcuugguccgggagcgccugccaugauggacgggaauggaccuauauuggcguggacgggccugauucuaaugcucugcuuaagaucaaauacggagaggccuacacggacacauaucacuccuacgcgaagaacauucugcgcacccaagaaagcgccuguaauugcaucggcggggauuguuaucucaugauuacagacggauccgcuucuggcaucagcgagugcagauuccugaaaauccgggagggccgcauuaucaaggaaauuuuucccaccgggagagucaagcacaccgaggaauguacaugcggauucgccuccaacaaaacgaucgagugugcuugccgggauaauagcuacaccgccaagcgcccguuugugaaacuuaacguugaaacagacaccgccgagauuagacugaugugcacagagaccuaucucgauacgccucggcccgacgauggcucuaucacagggccuugugaauccaauggagacaagggcagcgggggaaucaaaggcggcuucgugcaucagcgcauggcuucuaagauugggagaugguacagccggaccauguccaaaaccaagagaaugggaaugggccuguaugucaaguacgacggggaucccuggacagacucugaggcgcuggcccucagcggagugaugguguccauggaggaacccggcugguacagcuuuggguucgaaaucaaagauaagaaaugcgacgucccuuguauuggcaucgagaugguucacgauggaggcaagaccacauggcauucugcugccacggccauuuauugccugaugggguccggacagcuucugugggacaccgugacaggcguggauauggcucucuga

SEQ ID NO: 212642 - RNA, 1401 nt, Artificial Sequence
  derived and/or modified sequence opt5 from neuraminidase__InfluenzaB__AGX21758
augcugcccagcaccauccagacacucacgcuguuccuuaccuccggcggggugcugcucucucuguacgucagcgccucccuuucuuaucugcucuacagcgacauucugcugaaguuuacaccuaccgagaucacaguuccgaccaugccccucgauugcgcuaacgccuccaaugugcaagcggugaacagaucugcuacaaaaggagucacccugcuucugccugaacccgaguggacguauccucggcucagcugucccggcuccaccuuccagaaggcccugcuuauuagcccucaccgcuuuggggaaacaaaaggaaauucugccccgcugaucauuagagagcccuucaucgcuugcggcccuaaggaauguaaacauuuugcccucacccacuacgcugcccagcccgggggauauuacaacggcacacgggaggaccgcaauaagcugagacaucugaucuccgugaagcucggcaaaauuccuaccguugagaacagcaucuuccacauggcggccuggucuggguccgcuugccaugauggaaaggaauggacguauauuggcguggacgggcccgauagcaaugcccugcuuaaaaucaaguacggagaggcuuacacagacaccuaucacucuuacgccaacaauauucugcggacacaggaauccgcguguaacugcaucggcgggaauuguuaucucaugauuaccgauggaagcgccuccggcaucucugagugccgcuuucugaaaaucagagagggccggauuaucaaggaaauuuucccgaccgggcgcgucaagcacacagaggaauguacgugcggauuugcuagcaacaaaaccaucgagugugccugcagagacaauuccuacacagcuaagcggccuuucgugaaacuuaacguugaaaccgauacagccgagauucgccugaugugcaccgagacguaucucgacacacccagaccugaugacggcagcaucaccgggcccugugaaucuaauggaaacaagggcuccgggggaaucaaaggcggcuuugugcaucaacggauggccagcaagauugggcgcugguacucuagaaccaugagcaaaacaaagcggaugggaaugggccuguaugucaaguacgauggggaccccuggaccgacuccgaugcucuggcgcucucuggagugauggugagcauggaggaaccuggcugguacuccuucggguuugagaucaaagacaagaaaugcgaugucccguguauuggcaucgaaaugguucacgacggaggcaaggagacauggcauagcgccgcuacggccauuuauugccugauggggucuggacagcuucugugggauaccgugacaggcguggacauggcccucuga

SEQ ID NO: 212643 - RNA, 1401 nt, Artificial Sequence
  derived and/or modified sequence opt5 from neuraminidase__InfluenzaB__AGX21769
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugccaacagaagcgccaccaaaggagugacacugcuucugcccgaaccugaguggaccuauccccggcucuccuguccuggcagcacguuccagaaggcucugcuuauuucuccccaccgcuuuggggaaaccaaaggaaauuccgccccucugaucauuagagagccguucaucgcuugcggccccaaggaauguaaacauuuugcccucacacacuacgcggcccagccugggggauauuacaacggcacccgggaggaccgcaauaagcugagacaucugaucagcgugaagcucggcaaaauucccacagucgagaacucuaucuuccacauggcugccugguccgggagcgcuugccaugauggacgggaauggaccuauauuggcguggacgggccugauucuaaugcccugcuuaagaucaaauacggagaggcguacacggacacauaucacuccuacgccaagaacauucugcgcacccaagaaagcgcuuguaauugcaucggcggggauuguuaucucaugauuacagacggauccgccucuggcaucagcgagugcagauuucugaaaauccgggagggccgcauuaucaaggaaauuuuccccaccgggagaguuaagcacaccgaggaauguacaugcggauuugcuuccaacaaaacgaucgagugugccugccgggauaauagcuacaccgccaagcgcccguucgugaaacuuaacgucgaaacagacaccgcugagauuagacugaugugcacaaagaccuaucucgauacgccucggcccaaugacggcucuaucacagggccuugugaguccgauggagacaaaggcagcgggggaaucaagggcggcuuugugcaucagcgcauggcgucuaaaauugggagaugguacagccggaccauguccaagaccaagagaaugggaaugggccuguauguuaaauacgacggggaucccuggacagacucugaagcccuggcucucagcggagugauggucuccauggaggaacccggcugguacagcuucggguuugagaucaaggauaaaaagugcgacgugccuuguauuggcaucgaaauggugcacgauggaggcaaaaccacauggcauucugccgccacggcuauuuauugccugaugggguccggacagcuucugugggacaccgucacaggcguugauauggcccucuga

SEQ ID NO: 212644 - RNA, 1401 nt, Artificial Sequence
  derived and/or modified sequence opt5 from neuraminidase__InfluenzaB__AGX21780
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaaccugaguggaccuauccccggcucuccuguccuggcagcacguuccagaaggcccugcuuauuucuccccaccgcuuuggggaaaccaaaggaaauuccgcuccucugaucauuagagagccguucaucgccugcggccccaaggaauguaaacauuuugcucucacacacuacgccgcgcagccugggggauauuacaacggcacccgggaggaccgcaauaagcugagacaucugaucagcgucaagcucggcaaaauucccacaguggagaacucuaucuuccacauggccgcuugguccgggagcgccugccaugauggacgggaauggaccuauauuggcguugacgggccugauucuaaugcucugcuuaagaucaaauacggagaggccuacacggacacauaucacuccuacgcgaagaacauucugcgcacccaagaaagcgccuguaauugcaucggcggggauuguuaucucaugauuacagacggauccgcuucuggcaucagcgagugcagauuucugaaaauccgggagggccgcauuaucaaggaaauuuuccccaccgggagagugaagcacaccgaggaauguacaugcggauuugccuccaacaaaacgaucgagugugcuugccgggauaauagcuacaccgccaagcgcccguucgucaaacuuaacguggaaacagacaccgccgagauuagacugaugugcacagagaccuaucucgauacgccucggcccaaugacggcucuaucacagggccuugugaauccaacggagauaagggcagcgggggaaucaaaggcggcuuuguucaucagcgcauggagucuaagauugggagaugguacagccggaccauguccaaaaccaagagaaugggaaugggccuguaugugaaguacgacggggaccccuggacagauucugaagcucuggcgcucagcggagucaugguguccauggaggaacccggcugguacagcuucggguuugagaucaaagacaagaaaugcgaugugccuuguauuggcaucgagaugguccacgacggaggcaagaccacauggcauucugccgcuacggccauuuauugccugaugggguccggacagcuucugugggauaccguuacaggcguggacaugacccucuga

SEQ ID NO: 212645 - RNA, 1401 nt, Artificial Sequence
  derived and/or modified sequence opt5 from neuraminidase__InfluenzaB__AGX21791
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacagcggcacccggggcgaccgcaacaagcugagacaucugaucucugucaagcucgggaaaauuccuacaguggaaaauuccaucuuccacauggccgcuuggagcggaucugccugccaugauggcaaggaguggaccuauauugggguugacggacccgauaacaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauaacuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaacaagcggaugggcauggggcuguaugugaaguacgacggagaccccugggcggauuccgacgcccuggcucucucuggcgucauggugagcauggaggagccugggugguacuccuucggcuuugaaaucaaagauaagaaaugcgacgugccguguauuggaaucgagaugguccacgauggcgggaaggaaaccuggcauagcgccgccacagcuauuuauugccugaugggaucuggccagcuucugugggacaccguuacagggguggauauggcccucuga

SEQ ID NO: 212646 - RNA, 1401 nt, Artificial Sequence
  derived and/or modified sequence opt5 from neuraminidase__InfluenzaB__AGX21802
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugccaacagaagcgccaccaaaggagugacacugcuucugcccgaaccugaguggaccuauccccggcucuccuguccuggcagcacguuccagaaggcucugcuuauuucuccccaccgcuuuggggaaaccaaaggaaauuccgccccucugaucauuagagagccguucaucgcuugcggccccaaggaauguaaacauuuugcccucacacacuacgcggcccagccugggggauauuacaacggcacccgggaggaccgcaauaagcugagacaucugaucagcgugaagcucggcaaaauucccacagucgagaacucuaucuuccacauggcugccugguccgggagcgcuugccaugauggacgggaauggaccuauauuggcguggacgggccugauucuaaugcccugcuuaagaucaaauacggagaggcguacacggacacauaucacuccuacgccaagaacauucugcgcacccaagaaagcgcuuguaauugcaucggcggggauuguuaucucaugauuacagacggauccgccucuggcaucagcgagugcagauuucugaaaauccgggagggccgcauuaucaaggaaauuuuccccaccgggagaguuaagcacaccgaggaauguacaugcggauuugcuuccaacaaaacgaucgagugugccugccgggauaauagcuacaccgccaagcgcccguucgugaaacuuaacgucgaaacagacaccgcugagauuagacugaugugcacagagaccuaucucgauacgccucggcccaaugacggcucuaucacagggccuugugaauccgauggagacaagggcagcgggggaaucaaaggcggcuuugugcaucagcgcauggcgucuaagauugggagaugguacagccggaccauguccaaaaccaagagaaugggaaugggccuguauguuaaguacgacggggaucccuggacagacucugaggcccuggcucucagcggagugauggucuccauggaggaacccggcugguacagcuucggguuugaaaucaaagauaagaaaugcgacgugccuuguauuggcaucgagauggugcacgauggaggcaagaccacauggcauucugccgccacggcuauuuauugccugaugggguccggacagcuucugugggacaccgucacaggcguugauauggcccucuga

SEQ ID NO: 212647 - RNA, 1401 nt, Artificial Sequence
  derived and/or modified sequence opt5 from neuraminidase__InfluenzaB__AGX21813
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuaaaaugccgcucgauugcgccaacgcgucuaauguucaggcugccaacagaagcgccacaaagggagugacccugcuucugcccgaaccugaguggacauauccccggcucuccuguccuggcagcaccuuccagaaagcucugcuuauuucuccccaccgcuuuggggaaacgaagggaaauuccgccccucugaucauuagagagccguucaucgcuugcggccccaaagaauguaagcauuuugcccucacccacuacgcggcccagccugggggauauuacaacggcacacgggaggaccgcaauaagcugagacaucugaucagcgugaaacucggcaagauucccaccgucgagaacucuaucuuccacauggcugccugguccgggagcgcuugccaugauggacgggaauggacauauauuggcguggacgggccugauucuaaugcccugcuuaaaaucaaguacggagaggcguacaccgacacguaucacuccuacgccaaaaacauucugcgcacacaagaaagcgcuuguaauugcaucggcggggauuguuaucucaugauuaccgacggauccgccucuggcaucagcgagugcagauuucugaagauccgggagggccgcauuaucaaggaaauuuuccccacagggagaguuaaacacaccgaggaauguaccugcggauuugcuuccaacaagacaaucgagugugccugccgggauaauagcuacacggccaaacgcccguucgugaaacuuaacgucgaaaccgacacagcugagauuagacugaugugcaccgagacauaucucgauaccccucggcccaaugacggcucuaucacggggccuugugaauccgauggagacaagggcagcgggggaaucaagggcggcuuugugcaucagcgcauggcgucuaaaauugggagaugguacagccggacaauguccaagaccaagagaaugggaaugggccuguauguuaaauacgacggggaucccuggaccgacucugaggcccuggcucucagcggagugauggucuccauggaggaacccggcugguacagcuucggguuugaaaucaaggauaaaaagugcgacgugccuuguauuggcaucgagauggugcacgauggaggcaaaacaaccuggcauucugccgccacagcuauuuauugccugaugggguccggacagcuucugugggacacggucaccggcguugauauggcccucuga

SEQ ID NO: 212648 - RNA, 1401 nt, Artificial Sequence
  derived and/or modified sequence opt5 from neuraminidase__InfluenzaB__AGX21824
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggacgggaauggacauauaucggcguugacgggccugauucuaaugcucugcuuaagauuaaauacggagaggccuacaccgacacguaucacuccuacgcgaagaacauccugcgcacacaagaaagcgccuguaauugcauuggcggggauuguuaucucaugaucaccgacggacccgcuuccggcaucucugagugcagauuucugaaaauucgggagggccgcaucauuaaggaaaucuucccgacagggagagugaagaacaccgaggaauguaccugcggauuugccagcaauaaaacaauugagugugcuugccgggauaacuccuacacggccaagcgcccuuucgucaaacuuaauguggaaaccgacacagccgagaucagacugaugugcaccgagacauaucucgauacgccccggccuaacgacggcagcaucaccgggcccugugaaucuaauggagauaagggcuccgggggaauuaaaggcggcuuuguucaccagcgcauggcuagcaagaucgggagaugguacucucggacaaugagcaaaaccaagagaaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccaugacggaggcaagacaaccuggcacagcgcugccacagccaucuauugccugauggggucuggacagcuucugugggauacgguuaccggcguggacauggcucucuga

SEQ ID NO: 212649 - RNA, 1401 nt, Artificial Sequence; identical to SEQ ID NO: 211767
  derived and/or modified sequence opt5 from neuraminidase__InfluenzaB__AGX21835

SEQ ID NO: 212650 - RNA, 1401 nt, Artificial Sequence; identical to SEQ ID NO: 212155
  derived and/or modified sequence opt5 from neuraminidase__InfluenzaB__AGX21846

SEQ ID NO: 212651 - RNA, 1401 nt, Artificial Sequence; identical to SEQ ID NO: 212155
  derived and/or modified sequence opt5 from neuraminidase__InfluenzaB__AGX21857

SEQ ID NO: 212652 - RNA, 1401 nt, Artificial Sequence; identical to SEQ ID NO: 211767
  derived and/or modified sequence opt5 from neuraminidase__InfluenzaB__AGX21868

SEQ ID NO: 212653 - RNA, 1401 nt, Artificial Sequence; identical to SEQ ID NO: 212153
  derived and/or modified sequence opt5 from neuraminidase__InfluenzaB__AGX21879

SEQ ID NO: 212654 - RNA, 1401 nt, Artificial Sequence
  derived and/or modified sequence opt5 from neuraminidase__InfluenzaB__AGX21890
augcugcccagcaccauccagacacucacgcuguuccuuaccuccggcggggugcugcucucucuguacgucagcgccucccuuucuuaucugcucuacagcgacauucugcugaaguuuucccaaacagagaucauugcuccuaucaugccgcucgauugcgccaacgcgucuaauguucaggcugugaaccacagcgccaccaaaggagugacacugcuucugcccgaaccugaguggaccuaucccagacucuccuguccuggcagcacauuccagaaggcccugcuuauuucuccccaucgguuuggggaaaccaaaggaaauuccgcuccucugaucauccgcgagccguucauugccugcggccccaaggaauguaaacacuuugcucucacgcauuacgccgcgcagccugggggauauuacaacggcaccagagaggaccggaauaagcugcgccaccugaucagcgucaagcucggcaaaauucccacaguggagaacucuaucuuccauauggccgcuugguccgggagcgccugccacgauggaagagaauggaccuauauuggcguugacgggccugauucuaaugcucugcuuaagaucaaauacggagaggccuacacagacaccuaucacuccuacgcgaagaacauucugcggacgcaagaaagcgccuguaauugcaucggcggggauuguuaucucaugaucacagacggacccgcuuccggcauuucugagugccgcuuucugaaaaucagagagggccggauuaucaaggaaauuuucccgaccgggcgcgugaagcauacagaggaauguaccugcggauuugccagcaacaaaaccaucgagugugcuugcagagauaauuccuacacagccaagcggccuuucgucaaacuuaacguggaaacggacaccgccgagauccgccugaugugcacagagaccuaucucgauacacccagaccuaaugacggcagcauuaccgggcccugugaaucuaacggagauaagggcuccgggggaaucaaaggcggcuuuguucaccagcggauggcuagcaagauugggcgcugguacucuagaacgaugagcaaaacaaagcggaugggaaugggccuguaugugaaguacgacggggaccccuggaccgauuccgaggcgcuggcccucucuggagucauggugagcauggaggaaccuggcugguacuccuucggguuugaaaucaaagacaagaaaugcgaugugccguguauuggcaucgagaugguccaugacggaggcaagaccacauggcacagcgcugccaccgccaucuauugccugauggggucuggacagcuucugugggauacaguuacgggcguggacauggcucucuga

SEQ ID NO: 212655 - RNA, 1401 nt, Artificial Sequence; identical to SEQ ID NO: 211767
  derived and/or modified sequence opt5 from neuraminidase__InfluenzaB__AGX21901

SEQ ID NO: 212656 - RNA, 1401 nt, Artificial Sequence; identical to SEQ ID NO: 211767
  derived and/or modified sequence opt5 from neuraminidase__InfluenzaB__AGX21912

SEQ ID NO: 212657 - RNA, 1401 nt, Artificial Sequence
  derived and/or modified sequence opt5 from neuraminidase__InfluenzaB__AGX21923
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaacagaagcgcuaccaaaggagugacacugcuucugcccgaaccugaguggaccuauccccggcucuccuguccuggcagcacguuccagaaggcccugcuuaucucuccccaccgcuuuggggaaaccaaaggaaauuccgccccucugauuaucagagagccguucaucgcuugcggccccaaggaauguaaacauuuugcccucacacacuacgcugcccagccugggggauauuacaacggcacccgggaggaccgcaauaagcugagacaucugauuagcgucaagcucggcaaaauccccacaguggagaacucuauuuuccacauggcggccugguccgggagcgcuugccaugauggacgggaauggaccuauaucggcguugacgggccugauucuaaugcccugcuuaagauuaaauacggagaggcuuacacggacacauaucacuccuacgccaagaacauccugcgcacccaagaaagcgcguguaauugcauuggcggggauuguuaucucaugaucacagacggacccgccuccggcaucucugagugcagauuucugaaaauucgggagggccgcaucauuaaggaaaucuucccgaccgggagagugaagcacaccgaggaauguacaugcggauuugcuagcaacaaaacgauugagugugccugccgggauaauuccuacaccgcuaagcgcccuuucgucaaacuuaacguggaaacagacaccgccgagaucagacugaugugcacagagaccuaucucgauacgccccggccuaaugacggcagcaucacagggcccugugaaucuaacggagauaagggcuccgggggaauuaaaggcggcuuuguucaucagcgcauggccagcaagaucgggagaugguacucucggaccaugagcaaaaccaagagaaugggaaugggccuguaugugaaguacgacggggaccccuggacagauuccgaggcucuggcgcucucuggagucauggugagcauggaggaaccuggcugguacuccuucggguuugaaauuaaagacaagaaaugcgaugugccguguaucggcauugagaugguccacgacggaggcaagaccacauggcauagcgccgcuacggccaucuauugccugauggggucuggacagcuucugugggauaccguuacaggcguggacauggcccucuga

SEQ ID NO: 212658 - RNA, 1401 nt, Artificial Sequence; identical to SEQ ID NO: 212654
  derived and/or modified sequence opt5 from neuraminidase__InfluenzaB__AGX21934

SEQ ID NO: 212659 - RNA, 1401 nt, Artificial Sequence; identical to SEQ ID NO: 212155
  derived and/or modified sequence opt5 from neuraminidase__InfluenzaB__AGX21945

SEQ ID NO: 212660 - RNA, 1401 nt, Artificial Sequence
  derived and/or modified sequence opt5 from neuraminidase__InfluenzaB__AGX21956
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacacaucuaauauccaggcgguuaacagaagcgcuaccaaaggagugacacugcuucugcccgaaccugaguggaccuauccccggcucuccuguccuggcagcacguuccagaaggcccugcuuauuucuccccaccgcuuuggggaaaccaaaggaaauuccgccccucugaucaucagagagccguucauugcuugcggccccaaggaauguaaacauuuugcccucacacacuacgcugcccagccugggggauauuacaacggcacccgggaggaccgcaauaagcugagacaucugaucagcgugaagcucggcaaaauucccacagucgagaacucuaucuuccacauggcggccugguccgggagcgcuugccaugauggacgggaauggaccuauauuggcguggacgggccugauucuaaugcccugcuuaagaucaaauacggagaggcuuacacggacacauaucacuccuacgccaagaacauucugcgcacccaagaaagcgcguguaauugcaucggcggggauuguuaucucaugaucacagacggacccgccuccggcauuucugagugcagauuucugaaaauccgggagggccgcauuaucaaggaaauuuucccgaccgggagaguuaagcacaccgaggaauguacaugcggauuugcuagcaacaaaacgaucgagugugccugccgggauaauuccuacaccgcuaagcgcccuuucgugaaacuuaacgucgaaacagacaccgccgagaucagacugaugugcacagagaccuaucucgauacgccccggccuaaugacggcagcauuacagggcccugugaaucuaacggagauaagggcuccgggggaaucaaaggcggcuuugugcaucagcgcauggccagcaagauugggagaugguacucucggaccaugagcaaaaccaagagaaugggaaugggccuguauguuaaguacgacggggaccccuggacagauuccgaggcucuggcgcucucuggagugauggucagcauggaggaaccuggcugguacuccuucggguuugaaaucaaagacaagaaaugcgaugugccguguauuggcaucgagauggugcacgacggaggcaagaccacauggcauagcgccgcuacggccaucuauugccugauggggucuggacagcuucugugggauaccgucacaggcguugacauggcccucuga

SEQ ID NO: 212661 - RNA, 1401 nt, Artificial Sequence; identical to SEQ ID NO: 212155
  derived and/or modified sequence opt5 from neuraminidase__InfluenzaB__AGX21967

SEQ ID NO: 212662 - RNA, 1401 nt, Artificial Sequence; identical to SEQ ID NO: 211767
  derived and/or modified sequence opt5 from neuraminidase__InfluenzaB__AGX21978

SEQ ID NO: 212663 - RNA, 1401 nt, Artificial Sequence; identical to SEQ ID NO: 212155
  derived and/or modified sequence opt5 from neuraminidase__InfluenzaB__AGX21989

SEQ ID NO: 212664 - RNA, 1401 nt, Artificial Sequence; identical to SEQ ID NO: 212153
  derived and/or modified sequence opt5 from neuraminidase__InfluenzaB__AGX22000

SEQ ID NO: 212665 - RNA, 1401 nt, Artificial Sequence
  derived and/or modified sequence opt5 from neuraminidase__InfluenzaB__AGX22011
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgaagccugggggauauuacaacggcacacgggaggaccgcaauaagcugagacaucugauuagcgucaaacucggcaagauccccaccguggagaacucuauuuuccacauggccgcuugguccgggagcgccugccaugauggacgggaauggacauauaucggcguugacgggccugauucuaaugcucugcuuaaaauuaaguacggagaggccuacaccgacacguaucacuccuacgcgaaaaacauccugcgcacacaggaaagcgccuguaauugcauuggcggggauuguuaucucaugaucaccgacggacccgcuuccggcaucucugagugcagauuucugaagauucgggagggccgcaucauuaaggaaaucuucccgacagggagagugaaacacaccgaggaauguaccugcggauuugccagcaacaagacaauugagugugcuugccgggauaauaacuacacggccaaacgcccuuucgucaaacuuaauguggaaaccgacacagccgagaucagacugaugugcaccgagacauaucucgauacgccccggccuaacgacggcuccaucaccgggcccugugaaagcaauggagauaagggcucugggggaauuaagggcggcuuuguucaucaacgcauggcuuccaaaaucgggagaugguacagccggacaaugucuaagaccaagagaaugggaaugggccuguaugugaaauacgacggggaccccuggaccgauagcgaggcgcuggcccucuccggagucauggugucuauggaggaaccuggcugguacagcuucggguuugaaauuaaggacaaaaagugcgaugugccguguaucggcauugagaugguccacgacggaggcaaaacaaccuggcauuccgcugccacagccaucuauugccugauggggagcggacagcuucugugggauacgguuaccggcguggacauggcucucuga

SEQ ID NO: 212666 - RNA, 1401 nt, Artificial Sequence; identical to SEQ ID NO: 211767
  derived and/or modified sequence opt5 from neuraminidase__InfluenzaB__AGX22033

SEQ ID NO: 212667 - RNA, 1401 nt, Artificial Sequence; identical to SEQ ID NO: 211767
  derived and/or modified sequence opt5 from neuraminidase__InfluenzaB__AGX22044

SEQ ID NO: 212668 - RNA, 1401 nt, Artificial Sequence; identical to SEQ ID NO: 212153
  derived and/or modified sequence opt5 from neuraminidase__InfluenzaB__AGX22055

SEQ ID NO: 212669 - RNA, 1401 nt, Artificial Sequence; identical to SEQ ID NO: 211767
  derived and/or modified sequence opt5 from neuraminidase__InfluenzaB__AGX22066

SEQ ID NO: 212670 - RNA, 1401 nt, Artificial Sequence; identical to SEQ ID NO: 212654
  derived and/or modified sequence opt5 from neuraminidase__InfluenzaB__AGX22077

SEQ ID NO: 212671 - RNA, 1401 nt, Artificial Sequence; identical to SEQ ID NO: 211769
  derived and/or modified sequence opt5 from neuraminidase__InfluenzaB__AGX22088

SEQ ID NO: 212672 - RNA, 1401 nt, Artificial Sequence; identical to SEQ ID NO: 212155
  derived and/or modified sequence opt5 from neuraminidase__InfluenzaB__AGX22099

SEQ ID NO: 212673 - RNA, 1401 nt, Artificial Sequence; identical to SEQ ID NO: 212153
  derived and/or modified sequence opt5 from neuraminidase__InfluenzaB__AGX22110

SEQ ID NO: 212674 - RNA, 1401 nt, Artificial Sequence; identical to SEQ ID NO: 212155
  derived and/or modified sequence opt5 from neuraminidase__InfluenzaB__AGX22132

SEQ ID NO: 212675 - RNA, 1401 nt, Artificial Sequence
  derived and/or modified sequence opt5 from neuraminidase__InfluenzaB__AGX22143
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggacgggaauggacauauaucggcguugacgggccugauucuaaugcucugcuuaagauuaaauacggagaggccuacaccgacacguaucacuccuacgcgaagaacauccugcgcacacaagaaagcgccuguaauugcauuggcggggauuguuaucucaugaucaccgacggacccgcuuccggcaucucugagugcagauuucugaaaauucgggagggccgcaucauuaaggaaaucuucccgacagggagagugaagcacaccgaggaauguaccugcggauuugccagcaacaaaacaauugagugugcuugccgggauaauuccuacacggccaagcgcccuuucgucaaacuuaacguggaaaccgacacagccgagaucagacugaugugcaccgagacauaucucgauacgccccggccuaaugacggcagcaucaccgggcccugugaaucuaacggagauaagggcuccgggggaauuaaaggcggcuuuguucaucagcgcauggcuagcaagaucgggagaugguacucucggacaauuagcaaaaccaagagaaugggaaugggccuguaugugaaguacgacggggaccccuggaccgauuccgaggcgcuggcccucucuggagucauggugagcauggaggaaccuggcugguacuccuucggguuugaaaucaaagacaagaaaugcgaugugccguguauuggcaucgagaugguccacgacggaggcaagacaaccuggcauagcgcugccacagccaucuauugccugauggggucuggacagcuucugugggauacgguuaccggcguggacauggcucucuga

SEQ ID NO: 212676 - RNA, 1401 nt, Artificial Sequence; identical to SEQ ID NO: 212675
  derived and/or modified sequence opt5 from neuraminidase__InfluenzaB__AGX22154

SEQ ID NO: 212677 - RNA, 1401 nt, Artificial Sequence; identical to SEQ ID NO: 212675
  derived and/or modified sequence opt5 from neuraminidase__InfluenzaB__AGX22165

SEQ ID NO: 212678 - RNA, 1401 nt, Artificial Sequence; identical to SEQ ID NO: 212654
  derived and/or modified sequence opt5 from neuraminidase__InfluenzaB__AGX22176

SEQ ID NO: 212679 - RNA, 1401 nt, Artificial Sequence; identical to SEQ ID NO: 212675
  derived and/or modified sequence opt5 from neuraminidase__InfluenzaB__AGX22187

SEQ ID NO: 212680 - RNA, 1401 nt, Artificial Sequence; identical to SEQ ID NO: 212675
  derived and/or modified sequence opt5 from neuraminidase__InfluenzaB__AGX22198

SEQ ID NO: 212681 - RNA, 1401 nt, Artificial Sequence; identical to SEQ ID NO: 212675
  derived and/or modified sequence opt5 from neuraminidase__InfluenzaB__AGX22209

SEQ ID NO: 212682 - RNA, 1401 nt, Artificial Sequence; identical to SEQ ID NO: 212153
  derived and/or modified sequence opt5 from neuraminidase__InfluenzaB__AGX22220

SEQ ID NO: 212683 - RNA, 1401 nt, Artificial Sequence; identical to SEQ ID NO: 212155
  derived and/or modified sequence opt5 from neuraminidase__InfluenzaB__AGX22231

SEQ ID NO: 212684 - RNA, 1401 nt, Artificial Sequence; identical to SEQ ID NO: 212654
  derived and/or modified sequence opt5 from neuraminidase__InfluenzaB__AGX22242

SEQ ID NO: 212685 - RNA, 1401 nt, Artificial Sequence; identical to SEQ ID NO: 212153
  derived and/or modified sequence opt5 from neuraminidase__InfluenzaB__AGX22253

SEQ ID NO: 212686 - RNA, 1401 nt, Artificial Sequence; identical to SEQ ID NO: 211767
  derived and/or modified sequence opt5 from neuraminidase__InfluenzaB__AGX22264

SEQ ID NO: 212687 - RNA, 1401 nt, Artificial Sequence; identical to SEQ ID NO: 212153
  derived and/or modified sequence opt5 from neuraminidase__InfluenzaB__AGX22275

SEQ ID NO: 212688 - RNA, 1401 nt, Artificial Sequence; identical to SEQ ID NO: 211767
  derived and/or modified sequence opt5 from neuraminidase__InfluenzaB__AGX22286

SEQ ID NO: 212689 - RNA, 1401 nt, Artificial Sequence
  derived and/or modified sequence opt5 from neuraminidase__InfluenzaB__AGX22297
augcugcccagcaccauccagacacucacgcuguuccuuacccugggcggggugcuccugucccuuuacgucucugccagccuguccuaucuccuguacucugacauucugcucaaguuuagccaaacagagaucaccgcuccuauuaugccgcuggauugcgccaacgcguccaauguucaggcugugaacagaucugccacaaaaggagugacccuucugcuccccgaaccugaguggacauauccccggcugagcuguccuggcuccaccuuccagaaggcccuucugaucagcccccaccgcuuuggggaaacgaaaggaaauucugcuccucucauuaucagagagccguucaucgccugcggccccaaggaauguaaacauuuugcucugacccacuacgccgcgcagccugggggauauuacaacggcacacgggaggaccgcaauaagcugagacaucucauuuccgucaagcugggcaaaauccccaccguggagaacagcauuuuccacauggccgcuuggucuggguccgccugccaugauggacgggaauggacauauaucggcguugacgggccugauagcaaugcccuucugaagauuaaauacggagaggcuuacaccgacacguaucacucuuacgcgaagaacauccuccgcacacaagaauccgccuguaauugcauuggcggggauuguuaucugaugaucaccgacggacccgcuagcggcaucuccgagugcagauuucuuaaaauucgggagggccgcaucauuaaggaaaucuucccgacagggagagugaagcacaccgaggaauguaccugcggauuugccucuaacaaaacaauugagugugcuugccgggauaauagcuacacggccaagcgcccuuucgucaaacugaacguggaaaccgacacagccgagaucagacucaugugcaccgagacauaucuggauacgccccggccuaaugacggcuccaucaccgggcccugugaaagcaacggagauaagggcucugggggaauuaaaggcggcuuuguucaucagcgcauggcuuccaagaucgggagaugguacagccggacaaugucuaaaaccaagagaaugggaaugggccuguaugugaaguacgacggggaccccuggaccgauagcgaggcgcucgcccuguccggagucauggugucuauggaggaaccuggcugguacagcuucggguuugaaauuaaagacaagaaaugcgaugugccguguaucggcauugagaugguccacgacggaggcaagacaaccuggcauuccgcugccacagccaucuauugccuuauggggagcggacagcugcucugggauacgguuaccggcguggacauggcucuguga

SEQ ID NO: 212690 - RNA, 1401 nt, Artificial Sequence; identical to SEQ ID NO: 211767
  derived and/or modified sequence opt5 from neuraminidase__InfluenzaB__AGX22308

SEQ ID NO: 212691 - RNA, 1401 nt, Artificial Sequence
  derived and/or modified sequence opt5 from neuraminidase__InfluenzaB__AGX22330
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacaugacagccugguccgggagcgcuugccaugauggaaaggaauggaccuauaucggcguugacgggccugauucuaaugcccugcuuaaaauuaaguacggagaggcuuacacggacacauaucacuccuacgccaaaaacauccugcggacccaagaaagcgcguguaauugcauuggcggggauuguuaucucaugaucacagacggacccgccuccggcaucucugagugccgcuuucugaagauuagagagggccggaucauuaaggaaaucuucccgaccgggcgcgugaaacacaccgaggaauguacaugcggauuugcuagcaacaagacgauugagugugccugcagagauaauuccuacaccgcuaaacggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaagggcggcuuuguucaucagcggauggccaccaaaaucgggcgcugguacagcagaaccaugucuaagacaaagcggaugggaaugggccuguaugugaaauacgacggggaucccuggaccgacagcgaggcucuggcgcucuccggagucauggugucuauggaggaaccuggcugguacagcuucggguuugaaauuaaggauaaaaagugcgacgugccguguaucggcauugagaugguccacgauggaggcaaaacaacguggcauuccgccgcuaccgccaucuauugccugauggggagcggacagcuucugugggacacaguuaccggcguggauauggcccucuga

SEQ ID NO: 212692 - RNA, 1401 nt, Artificial Sequence; identical to SEQ ID NO: 212155
  derived and/or modified sequence opt5 from neuraminidase__InfluenzaB__AGX22341

SEQ ID NO: 212693 - RNA, 1401 nt, Artificial Sequence; identical to SEQ ID NO: 212155
  derived and/or modified sequence opt5 from neuraminidase__InfluenzaB__AGX22352

SEQ ID NO: 212694 - RNA, 1401 nt, Artificial Sequence; identical to SEQ ID NO: 212155
  derived and/or modified sequence opt5 from neuraminidase__InfluenzaB__AGX22363

SEQ ID NO: 212695 - RNA, 1401 nt, Artificial Sequence; identical to SEQ ID NO: 212153
  derived and/or modified sequence opt5 from neuraminidase__InfluenzaB__AGX22374

SEQ ID NO: 212696 - RNA, 1401 nt, Artificial Sequence; identical to SEQ ID NO: 211767
  derived and/or modified sequence opt5 from neuraminidase__InfluenzaB__AGX22385

SEQ ID NO: 212697 - RNA, 1401 nt, Artificial Sequence; identical to SEQ ID NO: 211767
  derived and/or modified sequence opt5 from neuraminidase__InfluenzaB__AGX22396

SEQ ID NO: 212698 - RNA, 1401 nt, Artificial Sequence; identical to SEQ ID NO: 212654
  derived and/or modified sequence opt5 from neuraminidase__InfluenzaB__AGX22407

SEQ ID NO: 212699 - RNA, 1401 nt, Artificial Sequence
  derived and/or modified sequence opt5 from neuraminidase__InfluenzaB__AGX22418
augcugcccagcaccauccagacacucacgcuguuccuuaccuccggcggggugcugcucucucuguacgucagcgccucccuuucuuaucugcucuacagcgacauucugcugaaguuuucccaaacagagaucauugcuccuaucaugccgcucgauugcgccaacgcgucuaauguucaggcugugaaccacagcgccaccaaaggagugacacugcuucugcccgaaccugaguggaccuaucccagacucuccuguccuggcagcacauuccagaaggcccugcuuauuucuccccaucgguuuggggaaaccaaaggaaauuccgcuccucugaucauccgcgagccguucauugccugcggccccaaggaauguaaacacuuugcucucacgcauuacgccgcgcagccugggagauauuacaacggaacccgggaggaccgcaauaagcugagacaccugaucagcgucaagcucggcaaaauucccacaguggagaacucuaucuuccauauggccgcuugguccggcagcgccugccacgaugggcgggaauggaccuauauuggaguugacggcccugauucuaaugcucugcuuaagaucaaauacggggaggccuacacagacaccuaucacuccuacgcgaagaacauucugcgcacgcaagaaagcgccuguaauugcaucggaggcgauuguuaucucaugaucacagacgggcccgcuuccggaauuucugagugcagauuucugaaaauccgggagggccgcauuaucaaggaaauuuucccgaccggcagagugaagcauacagaggaauguaccugcggguuugccagcaacaaaaccaucgagugugcuugccgggauaauuccuacacagccaagcgcccuuucgucaaacuuaacguggaaacggacaccgccgagaucagacugaugugcacagagaccuaucucgauacaccccggccuaaugacggaagcauuaccggccccugugaaucuaacggggauaagggauccggcgggaucaaaggaggcuuuguucaccagcgcauggcuagcaagauuggcagaugguacucucggacgaugagcaaaacaaagagaauggggaugggacuguaugugaaguacgacggcgaccccuggaccgauuccgaggcgcuggcccucucuggggucauggugagcauggaggaaccuggaugguacuccuucggcuuugaaaucaaagacaagaaaugcgaugugccguguauugggaucgagaugguccaugacggcggaaagaccacauggcacagcgcugccaccgccaucuauugccugaugggcucugggcagcuucugugggauacaguuacgggaguggacauggcucucuga

SEQ ID NO: 212700 - RNA, 1401 nt, Artificial Sequence; identical to SEQ ID NO: 212153
  derived and/or modified sequence opt5 from neuraminidase__InfluenzaB__AGX22429

SEQ ID NO: 212701 - RNA, 1401 nt, Artificial Sequence; identical to SEQ ID NO: 212153
  derived and/or modified sequence opt5 from neuraminidase__InfluenzaB__AGX22440

SEQ ID NO: 212702 - RNA, 1401 nt, Artificial Sequence; identical to SEQ ID NO: 212153
  derived and/or modified sequence opt5 from neuraminidase__InfluenzaB__AGX22449

SEQ ID NO: 212703 - RNA, 1401 nt, Artificial Sequence
  derived and/or modified sequence opt5 from neuraminidase__InfluenzaB__AGX22460
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccaccaaaggagugacacugcuucugcccgaacucgaguggaccuauccucggcuguccugucccggcagcacguuccagaaggcccuucugauuucuccucaccgcuuuggggaaaccaaaggaaauuccgcuccccucaucauuagagagccuuucaucgccugcggcccgaaggaauguaaacauuuugcucugacacacuacgccgcgcagcccgggggauauuacaacggcacccgggaggaccgcaauaagcugagacaucucaucagcgucaagcugggcaaaauuccuacaguggagaacucuaucuuccacauggccgcuugguccgggagcgccugccaugauggacgggaauggaccuauguuggcguggacgggcccgauucuaaugcccuucugaagauuaaauacggagaggcuuacacggacacauaucacuccuacgcgaagaacauccuccgcacccaagaaagcgccuguaauugcauuggcggggauuguuaucugaugaucacagacggaccugcuuccggcauuucugagugcagauuucuuaaaauccgggagggccgcaucauuaaggaaaucuuccccaccgggagagucaagcacaccgaggaauguacaugcggauuugccagcaacaaaacgauugagugugcuugccgggauaauuccuacaccgccaagcgcccguucgugaaacuggacguugaaacagauaccgccgagaucagacucaugugcacagagaccuaucuggacacgccucggcccaacgauggcagcauuacagggccuugugaagcuaauggagacaagggcucugggggaaucaaaggcggcuuugugcaucagcgcauggcguccaagaucgggagaugguacagccggaccaugucuaaaaccaagagaaugggaaugggccuguaugucaaguacgacggggaucccuggacagacagcgaggcccucgcucuguccggagugauggugucuauggaggaacccggcugguacagcuucggguuugaaauuaaagauaagaaaugcgacgucccuuguaucggcauugagaugguucacgauggaggcaagaccacauggcauuccgccgccacggcuaucuauugccuuauggggagcggacagcugcucugggacaccgugacaggcguggauauggcccuguga

SEQ ID NO: 212704 - RNA, 1401 nt, Artificial Sequence; identical to SEQ ID NO: 211767
  derived and/or modified sequence opt5 from neuraminidase__InfluenzaB__AGX22471

SEQ ID NO: 212705 - RNA, 1401 nt, Artificial Sequence; identical to SEQ ID NO: 211767
  derived and/or modified sequence opt5 from neuraminidase__InfluenzaB__AGX22482

SEQ ID NO: 212706 - RNA, 1401 nt, Artificial Sequence; identical to SEQ ID NO: 211767
  derived and/or modified sequence opt5 from neuraminidase__InfluenzaB__AGX22493

SEQ ID NO: 212707 - RNA, 1401 nt, Artificial Sequence
  derived and/or modified sequence opt5 from neuraminidase__InfluenzaB__AGX22504
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccauuccgcucgauugcgccaacgcgucuaauguucaagcugugaacagaagcgccacaaaaggagugacccugcuucugcccgaaccugaguggacguauccccggcucuccuguccuggcagcaccuuccagaaggcccugcuuaucucuccccaccgcuuuggggaaacaaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggaaaggaauggacguauaucggcguugacgggccugauucuaaugcucugcuuaaaauuaaguacggagaggccuacacagacaccuaucacuccuacgcgaacaauauccugcggacacaggaaagcgccuguaacugcauuggcgggaauuguuaucucaugaucaccgauggauccgcuucuggcaucagcgagugccgcuuucugaaaauuagagagggccggaucauuaaggaaaucuuccccaccgggcgcgugaagcacacagaggaauguacgugcggauuugccuccaacaaaaccauugagugugcuugcagagacaauagcuacacagccaagcggccguucgucaaacuuaacguggaaaccgauacagccgagauccgccugaugugcaccgagacguaucucgacacaccuagacccgaugacggcucuaucaccgggccuugugaauccaauggaaacaagggcagcgggggaauuaaaggcggcuuuguucaucaacggauggcuucuaagaucgggcgcugguacagcagaaccauguccaaaacaaagcggaugggaaugggccuguaugugaaguacgauggggaccccuggaccgacucugaugcgcuggcccucagcggagucaugguguccauggaggaacccggcugguacagcuucggguuugagauuaaagacaagaaaugcgaugugccuuguaucggcauugaaaugguccacgacggaggcaaggagacauggcauucugcugccacggccaucuauugccugaugggguccggacagcuucugugggauaccguuacaggcguggacauggcucucuga

SEQ ID NO: 212708 - RNA, 1401 nt, Artificial Sequence; identical to SEQ ID NO: 212153
  derived and/or modified sequence opt5 from neuraminidase__InfluenzaB__AGX22515

SEQ ID NO: 212709 - RNA, 1401 nt, Artificial Sequence
  derived and/or modified sequence opt5 from neuraminidase__InfluenzaB__AGX22526
augcugcccagcaccauccagacacucacgcuguuccuuaccuccggcggggugcugcucucucuguacgucagcgccucccuuucuuaucugcucuacagcgacauucugcaaaaguuuucccagacagagaucaccgcuccuauuaugccgcuggauugcgccaacgcgucuaauguucaggcugugaacagaagcgccacaaaaggagugacccuccugcuucccgaaccugaguggacauauccccggcuguccuguccuggcagcaccuuccagaaggcccuccugaucucuccccaccgcuuuggggaaacgaaaggaaauuccgcuccucuuauuaucagagagccguucaucgccugcggccccaccgaauguaagcauuuugcucugacacacuacgccgcgcaaccugggggauauuacaacggcacccgggaggaccgcaauaaacucagacaucugauuagcgucaagcugggcaagauccccacaguggagaacucuauuuuccacauggccgcuugguccgggagcgccugccaugauggaaaagaauggaccuauaucggcguugacgggccugauucuaaugcucuccugaagauuaaauacggagaggccuacacggacacauaucacuccuacgcgaagaacauccuucggacccaggaaagcgccuguaauugcauuggcggggauuguuaucugaugaucacagacggacccgcuuccggcaucucugagugccgcuuucucaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacugaacguggaaacagacaccgccgagauccgccuuaugugcacagagaccuaucuggauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccucuaugugaaguacgacggggaucccuggacagacuccgaggcgcuggcccugucuggagucauggugagcauggaggaaccuggcugguacuccuucggguuugaaauuaaagauaagaaaugcgacgugccguguaucggcauugagaugguccacgauggaggcaagaccacauggcauagcgcugccacggccaucuauugccucauggggucuggacagcugcuuugggacaccguuacaggcguggauauggcucuguga

SEQ ID NO: 212710 - RNA, 1401 nt, Artificial Sequence; identical to SEQ ID NO: 211812
  derived and/or modified sequence opt5 from neuraminidase__InfluenzaB__AGX22548

SEQ ID NO: 212711 - RNA, 1401 nt, Artificial Sequence; identical to SEQ ID NO: 211651
  derived and/or modified sequence opt5 from neuraminidase__InfluenzaB__AGX22559

SEQ ID NO: 212712 - RNA, 1401 nt, Artificial Sequence; identical to SEQ ID NO: 211812
  derived and/or modified sequence opt5 from neuraminidase__InfluenzaB__AGX22570

SEQ ID NO: 212713 - RNA, 1401 nt, Artificial Sequence
  derived and/or modified sequence opt5 from neuraminidase__InfluenzaB__AGX22581
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaaggaauguaaacauuuugcucucacccacuacgccgcgcagccugggggauauuacaacggcacacgggaggaccgcaauaagcugagacaucugauuagcgucaagcucggcaaaauccccaccguggagaacucuauuuuccacauggccgcuugguccgggagcgccugccaugauggacgggaauggacauauaucggcguugacgggccugauaauaacgcucugcuuaagauuaaauacggagaggccuacaccgacacguaucacucuuacgcgaagaauauccugcgcacacaagaauccgccuguaacugcauuggcggggauuguuaucucaugaucaccgacggacccgcuagcggcaucuccgagugcagauuucugaaaauucgggagggccgcaucauuaaggaaaucuucccgacagggagagugaagcacaccgaggaauguaccugcggauuugccucuaauaaaacaauugagugugcuugccgggauaacaauuacacggccaagcgcccuuucgucaaacuuaacguggaaaccgacacagccgagaucagacugaugugcaccgagacauaucucgauacgccccggccuaaugacggcagcaucaccgggcccugugaauccaacggagauaagggcagcgggggaauuaaaggcggcuuuguucaucagcgcauggcuucuaagaucgggagaugguacucccggacaaugagcaaaaccaagagaaugggaaugggccuguaugugaaguacgacggggaccccuggaccgauucugaggcgcuggcccucagcggagucaugguguccauggaggaaccuggcugguacucuuucggguuugaaauuaaagacaagaaaugcgaugugccguguaucggcauugagaugguccacgacggaggcaagacaaccuggcauagcgcugccacagccaucuauugccugaugggguccggacagcuucugugggauacgguuaccggcguggacauggcucucuga

SEQ ID NO: 212714 - RNA, 1401 nt, Artificial Sequence; identical to SEQ ID NO: 211812
  derived and/or modified sequence opt5 from neuraminidase__InfluenzaB__AGX22592

SEQ ID NO: 212715 - RNA, 1401 nt, Artificial Sequence; identical to SEQ ID NO: 211812
  derived and/or modified sequence opt5 from neuraminidase__InfluenzaB__AGX22603

SEQ ID NO: 212716 - RNA, 1401 nt, Artificial Sequence; identical to SEQ ID NO: 212052
  derived and/or modified sequence opt5 from neuraminidase__InfluenzaB__AGX22614

SEQ ID NO: 212717 - RNA, 1401 nt, Artificial Sequence; identical to SEQ ID NO: 211812
  derived and/or modified sequence opt5 from neuraminidase__InfluenzaB__AGX22625

SEQ ID NO: 212718 - RNA, 1401 nt, Artificial Sequence
  derived and/or modified sequence opt5 from neuraminidase__InfluenzaB__AGX22636
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggaguggcucugcuucugcccgaaccugaguggacauauccccggcucuccuguccuggcagcaccuuccagaaggcccugcuuaucucuccccaccgcuuuggggaaacaaaaggaaauuccgcuccucugauuaucagagagccguucaucgccugcggccccaccgaauguaagcauuuugcgcucacgcacuacgccgcucagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcgcugcuuaagauuaaauacggagaggccuacacagacaccuaucacuccuacgcuaagaacauccugcggacgcaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacacagaggaauguaccugcggauuugccagcaacaaaaccauugagugugccugcagagauaauuccuacacagcuaagcggccuuucgucaaacuuaacguggaaacggacaccgcggagauccgccugaugugcacagagaccuaucucgauacacccagaccuaaugacggcagcaucaccgggcccugugaaucugauggagacaagggcuccgggggaauuaaaggcggcuuuguucaucagcggauggccagcaagaucgggcgcugguacucuagaacgaugagcaaaacaaagcggaugggaaugggccuguaugugaaguacgacggggaucccuggaccgacuccgaggcucuggcccucucuggagucauggugagcauggaggaaccuggcugguacuccuucggguuugaaauuaaagauaagaaaugcgacgugccguguaucggcauugagaugguccacgauggaggcaagaccacauggcauagcgccgcuaccgccaucuauugccugauggggucuggacagcuucugugggacacaguuacgggcguggauauggcgcucuga

SEQ ID NO: 212719 - RNA, 1401 nt, Artificial Sequence; identical to SEQ ID NO: 211812
  derived and/or modified sequence opt5 from neuraminidase__InfluenzaB__AGX22647

SEQ ID NO: 212720 - RNA, 1401 nt, Artificial Sequence; identical to SEQ ID NO: 211651
  derived and/or modified sequence opt5 from neuraminidase__InfluenzaB__AGX22658

SEQ ID NO: 212721 - RNA, 1401 nt, Artificial Sequence; identical to SEQ ID NO: 211812
  derived and/or modified sequence opt5 from neuraminidase__InfluenzaB__AGX22669

SEQ ID NO: 212722 - RNA, 1401 nt, Artificial Sequence; identical to SEQ ID NO: 211812
  derived and/or modified sequence opt5 from neuraminidase__InfluenzaB__AGX22680

SEQ ID NO: 212723 - RNA, 1401 nt, Artificial Sequence; identical to SEQ ID NO: 211812
  derived and/or modified sequence opt5 from neuraminidase__InfluenzaB__AGX22691

SEQ ID NO: 212724 - RNA, 1401 nt, Artificial Sequence; identical to SEQ ID NO: 211812
  derived and/or modified sequence opt5 from neuraminidase__InfluenzaB__AGX22702

SEQ ID NO: 212725 - RNA, 1401 nt, Artificial Sequence; identical to SEQ ID NO: 211812
  derived and/or modified sequence opt5 from neuraminidase__InfluenzaB__AGX22713

SEQ ID NO: 212726 - RNA, 1401 nt, Artificial Sequence
  derived and/or modified sequence opt5 from neuraminidase__InfluenzaB__AGX22724
augcugcccagcaccauccagacacucacgcuguuccuuaccuccggcggggugcugcucucucuguacgucagcgcccuucuguccuaucuccuguacucugacauucugcucaaguuuagccaaacagagaucaccgcuccuauuaugccgcuggauugcgccaacgcguccaauguucaggcugugaacagaucugccacaaaaggagugacccuucugcuccccgaaccugaguggacauauccccggcugagcuguccuggcuccaccuuccagaaggcccuucugaucagcccccaccgcuuuggggaaacgaaaggaaauucugcuccucucauuaucagagagccguucaucgccugcggccccaaggaauguaaacauuuugcucugacccacuacgccgcgcagccugggggauauuacaacggcacacgggaggaccgcaauaagcugagacaucucauuuccgucaagcugggcaaaauccccaccguggagaacagcauuuuccacauggccgcuuggucuggguccgccugccaugauggacgggaauggacauauaucggcguugacgggccugauagcaaugcccuucugaagauuaaauacggagaggcuuacaccgacacguaucacucuuacgcgaagaacauccuccgcacacaagaauccgccuguaauugcauuggcggggauuguuaucugaugaucaccgacggacccgcuagcggcaucuccgagugcagauuucuuaaaauucgggagggccgcaucauuaaggaaaucuucccgacagggagagugaagcacaccgaggaauguaccugcggauuugccucuaacaaaacaauugagugugcuugccgggauaauagcuacacggccaagcgcccuuucgucaaacugaacguggaaaccgacacagccgagaucagacucaugugcaccgagacauaucuggauacgccccggccuaaugacggcuccaucaccgggcccugugaaagcaacggagauaagggcucugggggaauuaaaggcggcuuuguucaucagcgcauggcuuccaagaucgggagaugguacagccggacaaugucuaaaaccaagagaaugggaaugggccuguaugugaaguacgacggggaccccuggaccgauagcgaggcgcucgcccuguccggagucauggugucuauggaggaaccuggcugguacagcuucggguuugaaauuaaagacaagaaaugcgaugugccguguaucggcauugagaugguccacgacggaggcaagacaaccuggcauuccgcugccacagccaucuauugccuuauggggagcggacagcugcucugggauacgguuaccggcguggacauggcucuguga

SEQ ID NO: 212727 - RNA, 1401 nt, Artificial Sequence; identical to SEQ ID NO: 211812
  derived and/or modified sequence opt5 from neuraminidase__InfluenzaB__AGX22735

SEQ ID NO: 212728 - RNA, 1401 nt, Artificial Sequence
  derived and/or modified sequence opt5 from neuraminidase__InfluenzaB__AGX22746
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaaccggacccgcgaggacagaaauaaacugcggcaucugauuagcgucaagcucggcaagauccccacaguggagaacucuauuuuccacauggccgcuugguccggcagcgccugccaugaugggaaagaauggaccuauaucggaguugacggcccugauucuaaugcucugcuuaagauuaaauacggggaggccuacacggacacauaucacuccuacgcgaagaacauccugcgcacccaagaaagcgccuguaauugcauuggaggcgauuguuaucucaugaucacagacgggcccgcuuccggaaucucugagugcagauuucugaaaauucgggagggccgcaucauuaaggaaaucuucccgaccggcagagugaagcacaccgaggaauguacaugcggguuugccagcaacaaaacgauugagugugcuugccgggauaauuccuacaccgccaagcgcccuuucgucaaacuuaacguggaaacagacaccgccgagaucagacugaugugcacagagaccuaucucgauacgccccggccuaaugacggaagcaucacaggccccugugaaucugauggggacaagggauccggcgggauuaaaggaggcuuuguucaucagcgcauggcuagcaagaucggcagaugguacucucggaccaugagcaaaaccaagagaauggggaugggacuguaugugaaguacgacggcgaucccuggacagacuccgaggcgcuggcccucucuggggucauggugagcauggaggaaccuggaugguacuccuucggcuuugaaauuaaagauaagaaaugcgacgugccguguaucgggauugagaugguccacgauggcggaaagaccacauggcauagcgcugccacggccaucuauugccugaugggcucugggcagcuucugugggacaccguuacaggaguggauauggcucucuga

SEQ ID NO: 212729 - RNA, 1401 nt, Artificial Sequence; identical to SEQ ID NO: 211812
  derived and/or modified sequence opt5 from neuraminidase__InfluenzaB__AGX22757

SEQ ID NO: 212730 - RNA, 1401 nt, Artificial Sequence; identical to SEQ ID NO: 211812
  derived and/or modified sequence opt5 from neuraminidase__InfluenzaB__AGX22768

SEQ ID NO: 212731 - RNA, 1401 nt, Artificial Sequence; identical to SEQ ID NO: 212153
  derived and/or modified sequence opt5 from neuraminidase__InfluenzaB__AGX22779

SEQ ID NO: 212732 - RNA, 1401 nt, Artificial Sequence; identical to SEQ ID NO: 211812
  derived and/or modified sequence opt5 from neuraminidase__InfluenzaB__AGX22790

SEQ ID NO: 212733 - RNA, 1401 nt, Artificial Sequence
  derived and/or modified sequence opt5 from neuraminidase__InfluenzaB__AGX22801
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacggggcgaccgcaauaaacugagacaucugauuagcgucaagcucgggaagauccccaccguggagaacucuauuuuccacauggcugccugguccggaagcgcuugccaugauggcaaagaguggacauauaucgggguugacggaccugauucuaaugcccugcuuaagauuaaauacggcgaagcguacaccgacacguaucacuccuacgccaagaacauccugcggacacaagagagcgcuuguaauugcauugggggaaacuguuaucucaugaucaccgauggcuccgccucuggcgugagcgaaugccgcuuucugaaaaucagagaggggcggauuaucaaggagauuuuccccacaggacgcgucaagcacaccgaagaguguaccugcggcuuugcuuccaauaaaacaaucgaaugugccugcagagacaacagcuacacggccaagcggccguucgugaaacuuaauguugagaccgauacagcugaaauucgccugaugugcaccgagacauaucucgacaccccuagacccaacgaugggucuaucacgggaccuugugaguccgacggcgauaaggggagcggaggcaucaaaggcggguuugugcaucagcggauggcgucuaagauuggacgcugguacagcagaacaauguccaaaaccaagcggaugggcauggggcuguaugucaaguacgacggagaccccuggaccgauucugaagcccuggcucucagcggcgugaugguguccauggaggaacccgggugguacagcuucggcuuugagaucaaagacaagaaaugcgaugucccuuguauuggaaucgaaaugguucacgacggcgggaagacaaccuggcauucugccgccacagcuauuuauugccugaugggauccggccagcuucugugggauacggugaccgggguggacauggcccucuga

SEQ ID NO: 212734 - RNA, 1401 nt, Artificial Sequence; identical to SEQ ID NO: 211812
  derived and/or modified sequence opt5 from neuraminidase__InfluenzaB__AGX22812

SEQ ID NO: 212735 - RNA, 1401 nt, Artificial Sequence; identical to SEQ ID NO: 211812
  derived and/or modified sequence opt5 from neuraminidase__InfluenzaB__AGX22823

SEQ ID NO: 212736 - RNA, 1401 nt, Artificial Sequence; identical to SEQ ID NO: 211812
  derived and/or modified sequence opt5 from neuraminidase__InfluenzaB__AGX22834

SEQ ID NO: 212737 - RNA, 1401 nt, Artificial Sequence; identical to SEQ ID NO: 211812
  derived and/or modified sequence opt5 from neuraminidase__InfluenzaB__AGX22845

SEQ ID NO: 212738 - RNA, 1401 nt, Artificial Sequence; identical to SEQ ID NO: 211812
  derived and/or modified sequence opt5 from neuraminidase__InfluenzaB__AGX22856

SEQ ID NO: 212739 - RNA, 1401 nt, Artificial Sequence; identical to SEQ ID NO: 211812
  derived and/or modified sequence opt5 from neuraminidase__InfluenzaB__AGX22867

SEQ ID NO: 212740 - RNA, 1401 nt, Artificial Sequence; identical to SEQ ID NO: 211812
  derived and/or modified sequence opt5 from neuraminidase__InfluenzaB__AGX22878

SEQ ID NO: 212741 - RNA, 1401 nt, Artificial Sequence
  derived and/or modified sequence opt5 from neuraminidase__InfluenzaB__AGX22889
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauucccauacggccaagcggccuuucgucaaacuuaacguggaaaccgacacagcugagauccgccugaugugcaccgagacauaccucgauacccccagaccuaaugacggcagcaucacggggcccugugaaucugauggagacaagggcuccgggggaauuaaaggcggcuuuguucaccagcggauggcgagcaagaucgggcgcugguauucuagaacaaugagcaaaaccaagcggaugggaaugggccuguacgugaaguaugacggggaucccuggaccgacuccgaggcccuggcucucucuggagucauggugagcauggaggaaccuggcugguacuccuucggguuugaaauuaaagauaagaaaugcgacgugccguguaucggcauugagaugguccaugauggaggcaagacaaccuggcacagcgccgccacagcuaucuacugccugauggggucuggacagcuucugugggacacgguuaccggcguggauauggcccucuga

SEQ ID NO: 212742 - RNA, 1401 nt, Artificial Sequence; identical to SEQ ID NO: 211651
  derived and/or modified sequence opt5 from neuraminidase__InfluenzaB__AGX22900

SEQ ID NO: 212743 - RNA, 1401 nt, Artificial Sequence
  derived and/or modified sequence opt5 from neuraminidase__InfluenzaB__AGX22911
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcacaucugagugccgcuuucugaaaaucagagagggccggauuaucaaggaaauuuucccgaccgggcgcgugaagcacaccgaggaauguacaugcggauuugcuagcaacaaaacgaucgagugugccugcagagauaauuccuacaccgccaagcggccuuucgucaaacuuaacguggaaacagacaccgcugagauucgccugaugugcacagagaccuaucucgauacgcccagaccuaaugacggcagcaucacagggcccugugaaucugauggagacaagggcuccgggggaaucaaaggcggcuuuguucaucagcggauggcgagcaagauugggcgcugguacucuagaaccaugagcaaaaccaagcggaugggaaugggccuguaugugaaguacgacggggaucccuggacagacuccgaggcccuggcucucucuggagucauggugagcauggaggaaccuggcugguacuccuucggguuugaaaucaaagauaagaaaugcgacgugccguguauuggcaucgagaugguccacgauggaggcaagaccacauggcauagcgccgccacggcuauuuauugccugauggggucuggacagcuucugugggacaccguuacaggcguggauauggcccucuga

SEQ ID NO: 212744 - RNA, 1401 nt, Artificial Sequence
  derived and/or modified sequence opt5 from neuraminidase__InfluenzaB__AGX22922
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccuguaugugaaguacgacggggaucccuggacagacaacgaggcgcuggcccucuccggagucauggugucuauggaggaaccuggcugguacagcuucggguuugaaauuaaagauaagaaaugcgacgugccguguaucggcauugagaugguccacgauggaggcaagaccacauggcauuccgcugccacggccaucuauugccugauggggagcggacagcuucugugggacaccguuacaggcguggauauggcucucuga

SEQ ID NO: 212745 - RNA, 1401 nt, Artificial Sequence; identical to SEQ ID NO: 211812
  derived and/or modified sequence opt5 from neuraminidase__InfluenzaB__AGX22933

SEQ ID NO: 212746 - RNA, 1401 nt, Artificial Sequence; identical to SEQ ID NO: 211812
  derived and/or modified sequence opt5 from neuraminidase__InfluenzaB__AGX22944

SEQ ID NO: 212747 - RNA, 1401 nt, Artificial Sequence; identical to SEQ ID NO: 211812
  derived and/or modified sequence opt5 from neuraminidase__InfluenzaB__AGX22955

SEQ ID NO: 212748 - RNA, 1401 nt, Artificial Sequence; identical to SEQ ID NO: 211812
  derived and/or modified sequence opt5 from neuraminidase__InfluenzaB__AGX22966

SEQ ID NO: 212749 - RNA, 1401 nt, Artificial Sequence; identical to SEQ ID NO: 211651
  derived and/or modified sequence opt5 from neuraminidase__InfluenzaB__AGX22977

SEQ ID NO: 212750 - RNA, 1401 nt, Artificial Sequence; identical to SEQ ID NO: 212067
  derived and/or modified sequence opt5 from neuraminidase__InfluenzaB__AGX22988

SEQ ID NO: 212751 - RNA, 1401 nt, Artificial Sequence
  derived and/or modified sequence opt5 from neuraminidase__InfluenzaB__AGX22999
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugagugggcuuauccccggcucuccuguccuggcagcaccuuccagaaggcccugcuuaucucuccccaccgcuuuggggaaacaaaaggaaauuccgcuccucugauuaucagagagccguucaucgccugcggccccaccgaauguaagcauuuugcgcucacgcacuacgccgcucagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcgcugcuuaagauuaaauacggagaggccuacacagacaccuaucacuccuacgcuaagaacauccugcggacgcaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacacagaggaauguaccugcggauuugccagcaacaaaaccauugagugugccugcagagauaauuccuacacagcuaagcggccuuucgucaaacuuaacguggaaacggacaccgcggagauccgccugaugugcacagagaccuaucucgauacacccagaccuaaugacggcagcaucaccgggcccugugaaucugauggagacaagggcuccgggggaauuaaaggcggcuuuguucaucagcggauggccagcaagaucgggcgcugguacucuagaacgaugagcaaaacaaagcggaugggaaugggccuguaugugaaguacgacggggaucccuggaccgacuccgaggcucuggcccucucuggagucauggugagcauggaggaaccuggcugguacuccuucggguuugaaauuaaagauaagaaaugcgacgugccguguaucggcauugagaugguccacgauggaggcaagaccacauggcauagcgccgcuaccgccaucuauugccugauggggucuggacagcuucugugggacacaguuacgggcguggauauggcgcucuga

SEQ ID NO: 212752 - RNA, 1401 nt, Artificial Sequence; identical to SEQ ID NO: 212751
  derived and/or modified sequence opt5 from neuraminidase__InfluenzaB__AGX23010

SEQ ID NO: 212753 - RNA, 1401 nt, Artificial Sequence; identical to SEQ ID NO: 211651
  derived and/or modified sequence opt5 from neuraminidase__InfluenzaB__AGX23021

SEQ ID NO: 212754 - RNA, 1401 nt, Artificial Sequence; identical to SEQ ID NO: 211812
  derived and/or modified sequence opt5 from neuraminidase__InfluenzaB__AGX23032

SEQ ID NO: 212755 - RNA, 1401 nt, Artificial Sequence
  derived and/or modified sequence opt5 from neuraminidase__InfluenzaB__AGX23043
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgcccugggcaucuccgagugccgcuuucuuaaaauuagagagggccggaucauuaaggaaaucuucccgacagggcgcgugaagcacaccgaggaauguaccugcggauuugcuucuaacaaaacaauugagugugccugcagagauaauagcuacacggccaagcggccuuucgucaaacugaacguggaaaccgacacagcugagauccgccucaugugcaccgagacauaucuggauacccccagaccuaaugacggcuccaucacggggcccugugaaagcgauggagacaagggcucugggggaauuaaaggcggcuuuguucaucagcggauggcguccaagaucgggcgcugguacagcagaacaaugucuaaaaccaagcggaugggaaugggccuguaugugaaguacgacggggaucccuggaccgacagcgaggcccucgcucuguccggagucauggugucuauggaggaaccuggcugguacagcuucggguuugaaauuaaagauaagaaaugcgacgugccguguaucggcauugagaugguccacgauggaggcaagacaaccuggcauuccgccgccacagcuaucuauugccuuauggggagcggacagcugcucugggacacgguuaccggcguggauauggcccuguga

SEQ ID NO: 212756 - RNA, 1401 nt, Artificial Sequence; identical to SEQ ID NO: 211651
  derived and/or modified sequence opt5 from neuraminidase__InfluenzaB__AGX23054

SEQ ID NO: 212757 - RNA, 1401 nt, Artificial Sequence; identical to SEQ ID NO: 211651
  derived and/or modified sequence opt5 from neuraminidase__InfluenzaB__AGX23065

SEQ ID NO: 212758 - RNA, 1401 nt, Artificial Sequence; identical to SEQ ID NO: 211651
  derived and/or modified sequence opt5 from neuraminidase__InfluenzaB__AGX23076

SEQ ID NO: 212759 - RNA, 1401 nt, Artificial Sequence; identical to SEQ ID NO: 211812
  derived and/or modified sequence opt5 from neuraminidase__InfluenzaB__AGX23087

SEQ ID NO: 212760 - RNA, 1401 nt, Artificial Sequence; identical to SEQ ID NO: 211651
  derived and/or modified sequence opt5 from neuraminidase__InfluenzaB__AGX23098

SEQ ID NO: 212761 - RNA, 1401 nt, Artificial Sequence
  derived and/or modified sequence opt5 from neuraminidase__InfluenzaB__AGX23109
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauucgcggcgauuguuaucucaugaucacagacgggcccgcuuccggaaucucugagugcagauuucugaaaauucgggagggccgcaucauuaaggaaaucuucccgaccggcagagugaagcacaccgaggaauguacaugcggguuugccagcaacaaaacgauugagugugcuugccgggauaauuccuacaccgccaagcgcccuuucgucaaacuuaacguggaaacagacaccgccgagaucagacugaugugcacagagaccuaucucgauacgccccggccuaaugacggaagcaucacaggccccugugaaucugauggggacaagggauccggcgggauuaaaggaggcuuuguucaucagcgcauggcuagcaagaucggcagaugguacucucggaccaugagcaaaaccaagagaauggggaugggacuguaugugaaguacgacggcgaucccuggacagacuccgaggcgcuggcccucucuggggucauggugagcauggaggaaccuggaugguacuccuucggcuuugaaauuaaagauaagaaaugcgacgugccguguaucgggauugagaugguccacgauggcggaaagaccacauggcauagcgcugccacggccaucuauugccugaugggcucugggcagcuucugugggacaccguuacaggaguggauauggcucucuga

SEQ ID NO: 212762 - RNA, 1401 nt, Artificial Sequence; identical to SEQ ID NO: 211812
  derived and/or modified sequence opt5 from neuraminidase__InfluenzaB__AGX23120

SEQ ID NO: 212763 - RNA, 1401 nt, Artificial Sequence
  derived and/or modified sequence opt5 from neuraminidase__InfluenzaB__AGX23131
augcugcccagcaccauccagacacucacgcuguuccuuaccuccggcggggugcugcucucucuguacgucagcgccucccuuucuuaucugcucuacagcgacauucugcugaaguuuucccaaacagagaucauugcuccuaucaugccgcucgauugcgccaacgcgucuaauguucaggcugugaacagaagcgccgccaaaggagugacccugcuucugcccgaaccugaguggacauauccccggcucuccuguccuggcagcaccuuccagaaggcucugcuuauuucuccccaccgcuuuggggaaacaaaaggaaauuccgccccucugaucaucagagagccguucauugcuugcggccccaccgaauguaagcauuuugcccucacgcacuacgcggcccagccugggggauauuacaacggcacccgggaggaccgcaauaaacugagacaucugaucagcgucaagcucggcaagauucccacaguggagaacucuaucuuccacauggcugccugguccgggagcgcuugccaugauggaaaagaauggaccuauauuggcguugacgggccugauucuaaugcccugcuuaagaucaaauacggagaggcguacacagacaccuaucacuccuacgccaagaacauucugcggacgcaagaaagcgcuuguaauugcaucggcggggauuguuaucucaugaucacagacggacccgccuccggcauuucugagugccgcuuucugaaaaucagagagggccggauuaucaaggaaauuuucccgaccgggcgcgugaagcacacagaggaauguaccugcggauuugcuagcaacaaaaccaucgagugugccugcagagauaauuccuacacagccaagcggccuuucgucaaacuuaacguggaaacggacaccgcugagauccgccugaugugcacagagaccuaucucgauacacccagaccuaaugacggcagcauuaccgggcccugugaaucugauggagacaagggcuccgggggaaucaaaggcggcuuuguucaucagcggauggcgagcaagauugggcgcugguacucuagaacgaugagcaaaacaaagcggaugggaaugggccuguaugugaaguacgacggggaucccuggaccgacuccgaggcccuggcucucucuggagucauggugagcauggaggaaccuggcugguacuccuucggguuugaaaucaaagauaagaaaugcgacgugccguguauuggcaucgagaugguccacgauggaggcaagaccacauggcauagcgccgccaccgcuaucuauugccugauggggucuggacagcuucugugggacacaguuacgggcguggauauggcccucuga

SEQ ID NO: 212764 - RNA, 1401 nt, Artificial Sequence; identical to SEQ ID NO: 211812
  derived and/or modified sequence opt5 from neuraminidase__InfluenzaB__AGX23142

SEQ ID NO: 212765 - RNA, 1401 nt, Artificial Sequence; identical to SEQ ID NO: 211651
  derived and/or modified sequence opt5 from neuraminidase__InfluenzaB__AGX23153

SEQ ID NO: 212766 - RNA, 1401 nt, Artificial Sequence; identical to SEQ ID NO: 211651
  derived and/or modified sequence opt5 from neuraminidase__InfluenzaB__AGX23164

SEQ ID NO: 212767 - RNA, 1401 nt, Artificial Sequence; identical to SEQ ID NO: 211651
  derived and/or modified sequence opt5 from neuraminidase__InfluenzaB__AGX23175

SEQ ID NO: 212768 - RNA, 1401 nt, Artificial Sequence
  derived and/or modified sequence opt5 from neuraminidase__InfluenzaB__AGX23186
augcugcccagcaccacacagacgcucacccuguuccuuacauccggcggggugcugcucucucuguacgucagcgccucccuuucuuaucugcucuacagcgacauccugcugaaguuuucccaaaccgagauuacagcuccuaucaugccgcucgauugcgccaacgcgucuaauguucaggcugugaacagaagcgccgccaaaggagugacccugcuucugcccgaaccugaguggacauauccccggcucuccuguccuggcagcaccuuccagaaggcucugcuuauuucuccccaccgcuuuggggaaacgaaaggaaauuccgccccucugaucauuagagagccguucaucgcuugcggccccaccgaauguaagcauuuugcccucacacacuacgcggcccagccugggggauauuacaacggcacccgggaggaccgcaauaaacugagacaucugaucagcgucaagcucggcaagauucccacaguggagaacucuaucuuccacauggcugccugguccgggagcgcuugccaugauggaaaagaauggaccuauauuggcguugacgggccugauucuaaugcccugcuuaagaucaaauacggagaggcguacacggacacauaucacuccuacgccaagaacauucugcggacccaagaaagcgcuuguaauugcaucggcggggauuguuaucucaugauuacagacggacccgccuccggcaucucugagugccgcuuucugaaaaucagagagggccggauuaucaaggaaauuuucccgaccgggcgcgugaagcacaccgaggaauguacaugcggauuugcuagcaacaaaacgaucgagugugccugcagagauaauuccuacaccgccaagcggccuuucgucaaacuuaacguggaaacagacaccgcugagauucgccugaugugcacagagaccuaucucgauacgcccagaccuaaugacggcagcaucacagggcccugugaaucugauggagacaagggcuccgggggaaucaaaggcggcuuuguucaucagcggauggcgagcaagauugggcgcugguacucuagaaccaugagcaaaaccaagcggaugggaaugggccuguaugugaaguacgacggggaucccuggacagacuccgaggcccuggcucucucuggagucauggugagcauggaggaaccuggcugguacuccuucggguuugaaaucaaagauaagaaaugcgacgugccguguauuggcaucgagaugguccacgauggaggcaagaccacauggcauagcgccgccacggcuauuuauugccugauggggucuggacagcuucugugggacaccguuacaggcguggauauggcccucuga

SEQ ID NO: 212769 - RNA, 1401 nt, Artificial Sequence; identical to SEQ ID NO: 211812
  derived and/or modified sequence opt5 from neuraminidase__InfluenzaB__AGX23197

SEQ ID NO: 212770 - RNA, 1401 nt, Artificial Sequence; identical to SEQ ID NO: 211812
  derived and/or modified sequence opt5 from neuraminidase__InfluenzaB__AGX23208

SEQ ID NO: 212771 - RNA, 1401 nt, Artificial Sequence; identical to SEQ ID NO: 211812
  derived and/or modified sequence opt5 from neuraminidase__InfluenzaB__AGX23219

SEQ ID NO: 212772 - RNA, 1401 nt, Artificial Sequence
  derived and/or modified sequence opt5 from neuraminidase__InfluenzaB__AGX23230
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccuggggaguauuacaacggaacacgggaggaccgcaauaaacugagacaucugauuagcgucaagcucggcaagauccccaccguggaaaacucuauuuuccacauggcugccugguccggcagcgcuugccaugaugggaaagaguggacauauaucggaguugacggcccugauucuaaugcccugcuuaagauuaaauacggggaagcguacaccgacacguaucacuccuacgccaagaacauccugcggacacaagagagcgcuuguaauugcauuggaggcgauuguuaucucaugaucaccgacgggcccuccucuggaaucagcgagugccgcuuucugaaaauuagagaaggccggaucauuaaggagaucuucccgacaggccgcgugaagcacaccgaagaguguaccugcggguuugccuccaacaaaacaauugaaugugcuugcagagauaauagcuacacggccaagcggccuuucgucaaacuuaacguggagaccgacacagccgagauccgccugaugugcaccgaaacauaucucgauacccccagaccuaaugacggaucuaucacgggccccugugaguccgauggggacaagggaagcggcgggauuaaaggaggcuuuguucaucagcggauggcuucuaagaucggccgcugguacagcagaacaauguccaaaaccaagcggauggggaugggacuguaugugaaguacgacggcgaucccuggaccgacucugaagcgcuggcccucagcggggucaugguguccauggaggaaccuggaugguacagcuucggcuuugagauuaaagauaagaaaugcgacgugccguguaucgggauugagaugguccacgauggcggaaagacaaccuggcauucugcugccacagccaucuauugccugaugggcuccgggcagcuucugugggacacgguuaccggaguggauauggcucucuga

SEQ ID NO: 212773 - RNA, 1401 nt, Artificial Sequence; identical to SEQ ID NO: 211651
  derived and/or modified sequence opt5 from neuraminidase__InfluenzaB__AGX23241

SEQ ID NO: 212774 - RNA, 1401 nt, Artificial Sequence; identical to SEQ ID NO: 211812
  derived and/or modified sequence opt5 from neuraminidase__InfluenzaB__AGX23252

SEQ ID NO: 212775 - RNA, 1401 nt, Artificial Sequence; identical to SEQ ID NO: 211812
  derived and/or modified sequence opt5 from neuraminidase__InfluenzaB__AGX23263

SEQ ID NO: 212776 - RNA, 1401 nt, Artificial Sequence; identical to SEQ ID NO: 211812
  derived and/or modified sequence opt5 from neuraminidase__InfluenzaB__AGX23274

SEQ ID NO: 212777 - RNA, 1401 nt, Artificial Sequence; identical to SEQ ID NO: 211651
  derived and/or modified sequence opt5 from neuraminidase__InfluenzaB__AGX23285

SEQ ID NO: 212778 - RNA, 1401 nt, Artificial Sequence; identical to SEQ ID NO: 211812
  derived and/or modified sequence opt5 from neuraminidase__InfluenzaB__AGX23296

SEQ ID NO: 212779 - RNA, 1401 nt, Artificial Sequence
  derived and/or modified sequence opt5 from neuraminidase__InfluenzaB__AGX23307
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgccaagaacauucugcggacacaagaaagcgcuuguaauugcaucggcggggauuguuaucucaugauuaccgacggacccgccuccggcaucucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaaaaccaagcggaugggaaugggccuguaugucaaguacgacggggaucccuggaccgacuccgaggcccuggcucucucuggagugauggugagcauggaggaaccuggcugguacuccuucggguuugaaaucaaagauaagaaaugcgacgucccguguauuggcaucgagaugguucacgauggaggcaagacaaccuggcauagcgccgccacagcuauuuauugccugauggggucuggacagcuucugugggacacggugaccggcguggauauggcccucuga

SEQ ID NO: 212780 - RNA, 1401 nt, Artificial Sequence; identical to SEQ ID NO: 212779
  derived and/or modified sequence opt5 from neuraminidase__InfluenzaB__AGX23318

SEQ ID NO: 212781 - RNA, 1401 nt, Artificial Sequence; identical to SEQ ID NO: 212779
  derived and/or modified sequence opt5 from neuraminidase__InfluenzaB__AGX23329

SEQ ID NO: 212782 - RNA, 1401 nt, Artificial Sequence; identical to SEQ ID NO: 212779
  derived and/or modified sequence opt5 from neuraminidase__InfluenzaB__AGX23340

SEQ ID NO: 212783 - RNA, 1401 nt, Artificial Sequence; identical to SEQ ID NO: 212779
  derived and/or modified sequence opt5 from neuraminidase__InfluenzaB__AGX23351

SEQ ID NO: 212784 - RNA, 1401 nt, Artificial Sequence; identical to SEQ ID NO: 212779
  derived and/or modified sequence opt5 from neuraminidase__InfluenzaB__AGX23362

SEQ ID NO: 212785 - RNA, 1401 nt, Artificial Sequence; identical to SEQ ID NO: 212779
  derived and/or modified sequence opt5 from neuraminidase__InfluenzaB__AGX23373

SEQ ID NO: 212786 - RNA, 1401 nt, Artificial Sequence; identical to SEQ ID NO: 212779
  derived and/or modified sequence opt5 from neuraminidase__InfluenzaB__AGX23384

SEQ ID NO: 212787 - RNA, 1401 nt, Artificial Sequence
  derived and/or modified sequence opt5 from neuraminidase__InfluenzaB__AGX23395
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgccaagaacauucugcggacacaagaaagcgcuuguaauugcaucggcggggauuguuaucucaugauuaccgacggacccgccuccggcaucucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaaaaccaagcggaugggaaugggccuguaugucaaguacgacggggaucccuggaccgacuccgaggcccuggcucucucuggagugauggugagcauggaggaaccuggcugguacuccuucggguuugaaaucaaagauaagaaaugcgacgucccguguauuggcaucgagaugguucacgauggaggcaagacaaccuggcauagcgccgccacagcuauuuauugccugauggggucuggacagcuucuguggaacacggugaccggcguggacauggcccucuga

SEQ ID NO: 212788 - RNA, 1401 nt, Artificial Sequence
  derived and/or modified sequence opt5 from neuraminidase__InfluenzaB__AGX23417
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacauuccugcuucccgaaccugaguggaccuauccccggcuguccuguccuggcagcacauuucagaaggcucuccugaucucuccccaccgcuucggggaaaccaaaggaaauuccgccccucuuauuaucagagagccguuuaucgcuugcggccccacggaauguaagcauuucgcccugacccacuacgcggcccagccugggggauauuacaacggcacacgggaggaccgcaauaaacucagacaucugauuagcgucaagcugggcaagauccccaccguggagaacucuauuuuucacauggcugccugguccgggagcgcuugccaugauggaaaagaauggacauauaucggcguugacgggccugauucuaaugcccuccugaagauuaaauacggagaggcguacaccgacacguaucacuccuacgccaagaacauccuucggacacaagaaagcgcuuguaauugcauuggcggggauuguuaucugaugaucaccgacggacccgccuccggcaucucugagugccgcuuccucaaaauuagagagggccggaucauuaaggaaaucuuuccgacagggcgcgugaagcacaccgaggaauguaccugcggauucgcuagcaacaaaacaauugagugugccugcagagauaauuccuacacggccaagcggccuuuugucaaacugaacguggaaaccgacacagcugagauccgccuuaugugcaccgagacauaucuggauacccccagaccuaaugacggcagcaucacggggcccugugaaucugauggagacaagggcuccgggggaauuaaaggcggcuucguucaucagcggauggcgagcaagaucgggcgcugguacucuagaacaaugagcaaaaccaagcggaugggaaugggccucuaugugaaguacgacggggaucccuggaccgacuccgaggcccuggcucugucuggagucauggugagcauggaggaaccuggcugguacuccuuuggguucgaaauuaaagauaagaaaugcgacgugccguguaucggcauugagaugguccacgauggaggcaagacaaccuggcauagcgccgccacagcuaucuauugccucauggggucuggacagcugcuuugggacacgguuaccggcguggauauggcccuguga

SEQ ID NO: 212789 - RNA, 1401 nt, Artificial Sequence; identical to SEQ ID NO: 212788
  derived and/or modified sequence opt5 from neuraminidase__InfluenzaB__AGX23428

SEQ ID NO: 212790 - RNA, 1401 nt, Artificial Sequence; identical to SEQ ID NO: 212171
  derived and/or modified sequence opt5 from neuraminidase__InfluenzaB__AGX23450

SEQ ID NO: 212791 - RNA, 1401 nt, Artificial Sequence
  derived and/or modified sequence opt5 from neuraminidase__InfluenzaB__AGX23461
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauauccaagcuguuaaccggagcgccacaaaaggagugacccugcuucugcccgaaccugaguggacauauccccgccucuccuguccuggcagcaccuuccagaaggcccugcuuauuucuccccacagauuuggggaaacgaaaggaaauuccgcuccucugaucauccgggagccguucauugccugcggccccaaggaauguaaacauuuugcucucacccacuacgccgcgcagccugggggauauuacaacggcacacgcgaggacagaaauaagcugcggcaucugaucagcgugaagcucggcaaaauucccaccgucgagaacucuaucuuccacauggccgcuugguccgggagcgccugccaugauggacgcgaauggacauauauuggcguggacgggccugauucuaaugcucugcuuaagaucaaauacggagaggccuacaccgacacguaucacuccuacgcgaagaacauucugagaacacaggaaagcgccuguaauugcaucggcggggauuguuaucucaugaucaccgacggacccgcuuccggcauuucugagugccgguuucugaaaauccgcgagggcagaauuaucaaggaaauuuucccgacagggcggguuaagcacaccgaggaauguaccugcggauuugccagcaacaaaacaaucgagugugcuugccgcgauaauuccuacacggccaagagaccuuucgugaaacuuaacgucgaaaccgacacagccgagauccggcugaugugcaccgagacauaucucgauacgccccgcccuaaugacggcagcauuaccgggcccugugaaucuaacggagauaagggcuccgggggaaucaaaggcggcuuugugcaucaaagaauggcuagcaagauugggcggugguacucuagaacaaugagcaaaaccaagcgcaugggaaugggccuguauguuaaguacgacggggaccccuggaccgauuccgaggcgcuggcccucucuggagugauggucagcaucgaggaaccuggcugguacuccuucggguuugaaauuaaagacaagaaaugcgaugugccguguaucggcaucgagauggugcacgacggaggcaagacaaccuggcauagcgcugccacagccauuuauugccugauggggucuggacagcuucugugggauacggucaccggcguugacauggcucucuga

SEQ ID NO: 212792 - RNA, 1401 nt, Artificial Sequence; identical to SEQ ID NO: 212171
  derived and/or modified sequence opt5 from neuraminidase__InfluenzaB__AGX23472

SEQ ID NO: 212793 - RNA, 1401 nt, Artificial Sequence; identical to SEQ ID NO: 211812
  derived and/or modified sequence opt5 from neuraminidase__InfluenzaB__AGX23483

SEQ ID NO: 212794 - RNA, 1401 nt, Artificial Sequence
  derived and/or modified sequence opt5 from neuraminidase__InfluenzaB__AGX23494
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgccaagaacauucugcggacacaagaaagcgcuuguaauugcaucggcggggauuguuaucucaugauuaccgacggacccgccuccggcaucucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccuguggaucugauggcgacaagggguccggaggcaucaaaggcggguuugugcaucagcggauggcgagcaagauuggacgcugguacucuagaacaaugagcaaaaccaagcggaugggcauggggcuguaugucaaguacgacggagaucccuggaccgacuccgaagcccuggcucucucuggcgugauggugagcauggaugagccugggugguacuccuucggcuuugaaaucaaagacaagaaaugcgaugucccguguauuggaaucgagaugguucacgacggcgggaagacaaccuggcauagcgccgccacagcuauuuauugccugaugggaucuggccagcuucugugggauacggugaccgggguggacauggcccucuga

SEQ ID NO: 212795 - RNA, 1401 nt, Artificial Sequence
  derived and/or modified sequence opt5 from neuraminidase__InfluenzaB__AGX23505
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauaauaacgcccugcuuaagauuaaauacggagaggcguacaccgacacguaucacucuuacgccaagaauauccugcggacacaagaauccgcuuguaacugcauuggcggggauuguuaucucaugaucaccgacggacccgccagcggcaucuccgagugccgcuuucugaaaauuagagagggccggaucauuaaggaaaucuucccgacagggcgcgugaagcacaccgaggaauguaccugcggauuugcuucuaauaaaacaauugagugugccugcagagauaacagcuacacggccaagcggccuuucgucaaacuuaauguggaaaccgacacagcugagauccgccugaugugcaccgagacauaucucgauacccccagaccuaacgacggcuccaucacggggcccugugaaagcgauggagacaagggcucugggggaauuaaaggcggcuuuguucaucagcggauggcguccaagaucgggcgcugguacagcagaacaaugucuaaaaccaagcggaugggaaugggccuguaugugaaguacgacggggaucccuggaccgacagcgaggcccuggcucucuccggagucauggugucuauggaggaaccuggcugguacagcuucggguuugaaauuaaagauaagaaaugcgacgugccguguaucggcauugagaugguccacgauggaggcaagacaaccuggcauuccgccgccacagcuaucuauugccugauggggagcggacagcuucugugggacacgguuaccggcguggauauggcccucuga

SEQ ID NO: 212796 - RNA, 1401 nt, Artificial Sequence
  derived and/or modified sequence opt5 from neuraminidase__InfluenzaB__AGX23516
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcgugucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaaagccaagcggaugggaaugggccuguaugucaaguacgacggggaucccuggaccgacuccgaggcucuggcccucucuggagugauggugagcauggaggaaccuggcugguacuccuucggguuugaaaucaaagauaagaaaugcgacgucccguguauuggcaucgagaugguucacgauggaggcaagaccacauggcauagcgccgcuaccgccauuuauugccugauggggucuggacagcuucugugggacacagugacgggcguggauauggcgcucuga

SEQ ID NO: 212797 - RNA, 1401 nt, Artificial Sequence; identical to SEQ ID NO: 211812
  derived and/or modified sequence opt5 from neuraminidase__InfluenzaB__AGX23527

SEQ ID NO: 212798 - RNA, 1401 nt, Artificial Sequence
  derived and/or modified sequence opt5 from neuraminidase__InfluenzaB__AGX23538
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccaagccugaauggaccuauccccggcucuccuguccuggcagcacauuccagaaagcucugcuuaucucuccccaccgcuuuggggagaccaagggaaauuccgccccucugauuaucagagaaccguucaucgcuugcggccccacggaguguaaacauuuugcccucacccacuacgcggcccagccugggggauauuacaacggcacacgggaagaccgcaauaagcugagacaucugauuagcgucaagcucggcaaaauccccaccguggagaacucuauuuuccacauggcugccugguccgggagcgcuugccaugauggaaaggaguggacauauaucggcguugacgggccugauucuaaugcccugcuuaaaauuaaguacggagaagcguacaccgacacguaucacuccuacgccaaaaacauccugcggacacaagagagcgcuuguaauugcauuggcggggauuguuaucucaugaucaccgacggacccgccuccggcgugucugaaugccgcuuucugaagaucagagagggccggauuaucaaggagauuuucccgacagggcgcgucaaacacaccgaagaguguaccugcggauuugcuagcaacaagacaaucgaaugugccugcagagauaauuccuacacggccaaacggccuuucgugaaacuuaacguugagaccgacacagcugaaauucgccugaugugcaccgagacauaucucgauacccccagaccuaaugacggcagcaucacggggcccugugagucugauggagacaagggcuccgggggaaucaagggcggcuuugugcaucagcggauggcgagcaaaauugggcgcugguacucuagaacaaugagcaccaccaagcggaugggaaugggccuguaugucaaguacgacggggaucccuggacagacuccgaagcccuggcucucucuggagugauggugagcauggaggaaccuggcugguacuccuucggguuugagaucaaagauaagaaaugcgacgucccguguauuggcaucgaaaugguucacgauggaggcaagaccacauggcauagcgccgccacggcuauuuauugccugauggggucuggacagcuucugugggacaccgugacaggcguggauauggcccucuga

SEQ ID NO: 212799 - RNA, 1401 nt, Artificial Sequence
  derived and/or modified sequence opt5 from neuraminidase__InfluenzaB__AGX23549
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcgugucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaccaccaaacggaugggaaugggccuguaugucaaguacgacggggaucccuggacagacuccgaggcccuggcucucucuggagugauggugagcauggaggaaccuggcugguacuccuucggguuugaaaucaaggauaaaaagugcgacgucccguguauuggcaucgagaugguucacgauggaggcaaaaccacauggcauagcgccgccacggcuauuuauugccugauggggucuggacagcuucugugggacaccgugacaggcguggauauggcccucuga

SEQ ID NO: 212800 - RNA, 1401 nt, Artificial Sequence; identical to SEQ ID NO: 211812
  derived and/or modified sequence opt5 from neuraminidase__InfluenzaB__AGX23560

SEQ ID NO: 212801 - RNA, 1401 nt, Artificial Sequence; identical to SEQ ID NO: 212794
  derived and/or modified sequence opt5 from neuraminidase__InfluenzaB__AGX23571

SEQ ID NO: 212802 - RNA, 1401 nt, Artificial Sequence; identical to SEQ ID NO: 212794
  derived and/or modified sequence opt5 from neuraminidase__InfluenzaB__AGX23582

SEQ ID NO: 212803 - RNA, 1401 nt, Artificial Sequence
  derived and/or modified sequence opt5 from neuraminidase__InfluenzaB__AGX23593
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccugacacucucuggagucauggugagcauggaggaaccuggcugguacuccuucggguuugaaauuaaagauaagaaaugcgacgugccguguaucggcauugagaugguccacgauggaggcaagaccacauggcauagcgcugccacggccaucuauugccugauggggucuggacagcuucugugggacaccguuacaggcguggauauggcucucuga

SEQ ID NO: 212804 - RNA, 1401 nt, Artificial Sequence; identical to SEQ ID NO: 211812
  derived and/or modified sequence opt5 from neuraminidase__InfluenzaB__AGX23604

SEQ ID NO: 212805 - RNA, 1401 nt, Artificial Sequence
  derived and/or modified sequence opt5 from neuraminidase__InfluenzaB__AGX23615
augcugcccagcaccauccagacacucacgcuguuccuuaccuccggcggggugcugcucucucuguacgucagcgccucccuuucuuaucugcucuacagcgacauucugcugaaguuuucccaaacagagaucaccacaccuauuaugccgcucgauugcgcuaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaacgaaaggaaauuccgcuccucugauuaucagagagccguucaucgccugcggccccaccgaauguaagcauuuugcucucacacacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacggacacauaucacuccuacgcgaagaacauccugcggacccaagaaagcgccuguaauugcauuggcggggauuguuaucucaugaucacagacggacccgcuuccggcaucucugagugccgcuuucugaaaauuagagagggccggaucauuaaggaaaucuucccgaccgggcgcgugaagcacaccgaggaauguacaugcggauuugccagcaacaaaacgauugagugugcuugcagagauaauuccuacaccgccaagcggccuuucgucaaacuuaacguggaaacagacaccgccgagauccgccugaugugcacagagaccuaucucgauacgcccagaccuaaugacggcagcaucacagggcccugugaaucugauggagacaagggcuccgggggaauuaaaggcggcuuuguucaucagcggauggcuagcaagaucgggcgcugguacucuagaaccaugagcaaaaccaagcggaugggaaugggccuguaugugaaguacgacggggaucccuggacagacuccgaggcgcuggcccucucuggagucauggugagcauggaggaaccuggcugguacuccuucggguuugaaauuaaagauaagaaaugcgacgugccguguaucggcauugagaugguccacgauggaggcaagaccacauggcauagcgcugccacggccaucuauugccugauggggucuggacagcuucugugggacaccguuacaggcguggauauggcucucuga

SEQ ID NO: 212806 - RNA, 1401 nt, Artificial Sequence; identical to SEQ ID NO: 212794
  derived and/or modified sequence opt5 from neuraminidase__InfluenzaB__AGX23626

SEQ ID NO: 212807 - RNA, 1401 nt, Artificial Sequence; identical to SEQ ID NO: 212171
  derived and/or modified sequence opt5 from neuraminidase__InfluenzaB__AGX23637

SEQ ID NO: 212808 - RNA, 1401 nt, Artificial Sequence; identical to SEQ ID NO: 211812
  derived and/or modified sequence opt5 from neuraminidase__InfluenzaB__AGX23659

SEQ ID NO: 212809 - RNA, 1401 nt, Artificial Sequence; identical to SEQ ID NO: 212171
  derived and/or modified sequence opt5 from neuraminidase__InfluenzaB__AGX23670

SEQ ID NO: 212810 - RNA, 1401 nt, Artificial Sequence; identical to SEQ ID NO: 212171
  derived and/or modified sequence opt5 from neuraminidase__InfluenzaB__AGX23681

SEQ ID NO: 212811 - RNA, 1401 nt, Artificial Sequence; identical to SEQ ID NO: 212171
  derived and/or modified sequence opt5 from neuraminidase__InfluenzaB__AGX23692

SEQ ID NO: 212812 - RNA, 1401 nt, Artificial Sequence; identical to SEQ ID NO: 212171
  derived and/or modified sequence opt5 from neuraminidase__InfluenzaB__AGX23703

SEQ ID NO: 212813 - RNA, 1401 nt, Artificial Sequence
  derived and/or modified sequence opt5 from neuraminidase__InfluenzaB__AGX23714
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgaaaagaacauucugcggacacaagagagcgccuguaauugcaucggcggggauuguuaucucaugauuaccgacggacccgcuuccggcaucucugagugccgcuuucugaaaaucagagaaggccggauuaucaaggagauuuucccgacagggcgcgucaagcacaccgaagaguguaccugcggauuugccagcaacaaaacaaucgaaugugcuugcagagauaauuccuacacggccaagcggccuuucgugaaacuuaacguugagaccgacacagccgagauucgccugaugugcaccgaaacauaucucgauacccccagaccuaaugacggcagcaucacggggcccuguggaucugauggcgacaagggguccggaggcaucaaaggcggguuugugcaucagcggauggcuagcaagauuggacgcugguacucuagaacaaugagcaaaaccaagcggaugggcauggggcuguaugucaaguacgacggagaucccuggaccgacuccgaggcgcuggcccucucuggcgugauggugagcauggaugaaccugggugguacuccuucggcuuugagaucaaagacaagaaaugcgaugucccguguauuggaaucgaaaugguucacgacggcgggaagacaaccuggcauagcgcugccacagccauuuauugccugaugggaucuggccagcuucugugggauacggugaccgggguggacauggcucucuga

SEQ ID NO: 212814 - RNA, 1401 nt, Artificial Sequence; identical to SEQ ID NO: 212171
  derived and/or modified sequence opt5 from neuraminidase__InfluenzaB__AGX23725

SEQ ID NO: 212815 - RNA, 1401 nt, Artificial Sequence; identical to SEQ ID NO: 212794
  derived and/or modified sequence opt5 from neuraminidase__InfluenzaB__AGX23736

SEQ ID NO: 212816 - RNA, 1401 nt, Artificial Sequence; identical to SEQ ID NO: 212171
  derived and/or modified sequence opt5 from neuraminidase__InfluenzaB__AGX23747

SEQ ID NO: 212817 - RNA, 1401 nt, Artificial Sequence; identical to SEQ ID NO: 212171
  derived and/or modified sequence opt5 from neuraminidase__InfluenzaB__AGX23758

SEQ ID NO: 212818 - RNA, 1401 nt, Artificial Sequence; identical to SEQ ID NO: 212794
  derived and/or modified sequence opt5 from neuraminidase__InfluenzaB__AGX23769

SEQ ID NO: 212819 - RNA, 1401 nt, Artificial Sequence
  derived and/or modified sequence opt5 from neuraminidase__InfluenzaB__AGX23780
augcugcccagcaccauccagacacucacgcugcuucugaccuccggcggggugcuccugucucuuuacgucagcgccucccugucuuaucuccuguacagcgacauucugcucaaguucucccaaacagagaucaccgcuccuauuaugccgcuggauugcgccaacgcgucuaauguucaggcugugaacagaagcgccgccaaaggagugacacuucugcuccccgaaccugaguggaccuauccccggcuguccuguccuggcagcacauuucagaaggcccuucugaucucuccccaccgcuucggggaaaccaaaggaaauuccgcuccucucauuaucagagagccguuuaucgcuugcggccccacggaauguaagcauuucgcccugacccacuacgcggcccagccugggggauauuacaacggcacacgggaggaccgcaauaaacugagacaucucauuagcgucaagcugggcaagauccccaccguggagaacucuauuuuucacauggcugccugguccgggagcgcuugccaugauggaaaagaauggacauauaucggcguugacgggccugauucuaaugcccuucugaagauuaaauacggagaggcguacaccgacacguaucacuccuacgccaagaacauccuccggacacaagaaagcgcuuguaauugcauuggcggggauuguuaucugaugaucaccgacggacccgccuccggcgugucugagugccgcuuccuuaaaaucagagagggccggauuaucaaggaaauuuuuccgacagggcgcgucaagcacaccgaggaauguaccugcggauucgcuagcaacaaaacaaucgagugugccugcagagauaauuccuacacggccaagcggccuuuugugaaacugaacguugaaaccgacacagcugagauucgccucaugugcaccgagacauaucuggauacccccagaccuaaugacggcagcaucacggggcccugugaaucugauggagacaagggcuccgggggaaucaaaggcggcuucgugcaucagcggauggcgagcaagauugggcgcugguacucuagaacaaugagcaaaaccaagcggaugggaaugggccuguaugucaaguacgacggggaucccuggaccgacuccgaggcccucgcucugucuggagugauggugagcauggaggaaccuggcugguacuccuuuggguucgaaaucaaagauaagaaaugcgacgucccguguauuggcaucgagaugguucacgauggaggcaagacaaccuggcauagcgccgccacagcuauuuauugccuuauggggucuggacagcugcucugggacacggugaccggcguggauauggcccuguga

SEQ ID NO: 212820 - RNA, 1401 nt, Artificial Sequence
  derived and/or modified sequence opt5 from neuraminidase__InfluenzaB__AGX23791
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaaugcucaggccguuaacagaagcgccgcuaaaggagugacacugcuucugcccgaaccugaguggaccuauccccggcucuccuguccuggcagcacauuccagaaggcccugcuuaucucuccccaccgcuuuggggaaaccaaaggaaauuccgcuccucugauuaucagagagccguucaucgccugcggccccacggaauguaagcauuuugcgcucacccacuacgccgcucagccugggggauauuacaacggcacacgggaggaccgcaauaaacugagacaucugauuagcgugaagcucggcaagauccccaccgucgagaacucuauuuuccacauggccgcuugguccgggagcgccugccaugauggaaaagaauggacauauaucggcguggacgggccugauucuaaugcgcugcuuaagauuaaauacggagaggccuacaccgacacguaucacuccuacgcuaagaacauccugcggacacaagaaagcgccuguaauugcauuggcggggauuguuaucucaugaucaccgacggacccgcuuccggcguuucugagugccgcuuucugaaaaucagagagggccggauuaucaaggaaauuuucccgacagggcgcgugaagcacaccgaggaauguaccugcggauuugccagcaacaaaacaaucgagugugccugcagagauaauuccuacacggcuaagcggccuuucgucaaacuuaacguggaaaccgacacagcggagauucgccugaugugcaccgagacauaucucgauacccccagaccuaaugacggcagcaucacggggcccugugaaucugauggagacaagggcuccgggggaaucaaaggcggcuuuguucaucagcggauggccagcaagauugggcgcugguacucuagaacaaugagcaaaaccaagcggaugggaaugggccuguaugugaaguacgacggggaucccuggaccgacuccgaggcucuggcccucucuggagucauggugagcauggaggaaccuggcugguacuccuucggguuugaaaucaaagauaagaaaugcgacgugccguguauuggcaucgagaugguccacgauggaggcaagacaaccuggcauagcgccgcuacagccauuuauugccugauggggucuggacagcuucugugggacacgguuaccggcguggauauggcgcucuga

SEQ ID NO: 212821 - RNA, 1401 nt, Artificial Sequence; identical to SEQ ID NO: 212794
  derived and/or modified sequence opt5 from neuraminidase__InfluenzaB__AGX23802

SEQ ID NO: 212822 - RNA, 1401 nt, Artificial Sequence; identical to SEQ ID NO: 212794
  derived and/or modified sequence opt5 from neuraminidase__InfluenzaB__AGX23813

SEQ ID NO: 212823 - RNA, 1401 nt, Artificial Sequence; identical to SEQ ID NO: 212794
  derived and/or modified sequence opt5 from neuraminidase__InfluenzaB__AGX23824

SEQ ID NO: 212824 - RNA, 1401 nt, Artificial Sequence; identical to SEQ ID NO: 212794
  derived and/or modified sequence opt5 from neuraminidase__InfluenzaB__AGX23846

SEQ ID NO: 212825 - RNA, 1401 nt, Artificial Sequence; identical to SEQ ID NO: 211812
  derived and/or modified sequence opt5 from neuraminidase__InfluenzaB__AGX23857

SEQ ID NO: 212826 - RNA, 1401 nt, Artificial Sequence; identical to SEQ ID NO: 212794
  derived and/or modified sequence opt5 from neuraminidase__InfluenzaB__AGX23868

SEQ ID NO: 212827 - RNA, 1401 nt, Artificial Sequence
  derived and/or modified sequence opt5 from neuraminidase__InfluenzaB__AGX23879
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagacaucuauuuuccacauggcugccugguccgggagcgcuugccaugauggaaaagaauggaccuauaucggcguugacgggccugauucuaacgcccugcuuaagauuaaauacggagaggcguacacggacacauaucacuccuacgccaagaauauccugcggacccaagaaagcgcuuguaacugcauuggcggggauuguuaucucaugaucacagacggacccgccuccggcgugucugagugccgcuuucugaaaaucagagagggccggauuaucaaggaaauuuucccgaccgggcgcgucaagcacaccgaggaauguacaugcggauuugcuagcaauaaaacgaucgagugugccugcagagauaacuccuacaccgccaagcggccuuucgugaaacuuaauguugaaacagacaccgcugagauucgccugaugugcacagagaccuaucucgauacgcccagaccuaacgacggcagcaucacagggcccugugaaucugauggagacaagggcuccgggggaaucaaaggcggcuuugugcaucagcggauggcgagcaagauugggcgcugguacucuagaaccaugagcaaaaccaagcggaugggaaugggccuguaugucaaguacgacggggaucccuggacagacuccgaggcccuggcucucucuggagugauggugagcauggaggaaccuggcugguacuccuucggguuugaaaucaaagauaagaaaugcgacgucccguguauuggcaucgagaugguucacgauggaggcaagaccacauggcauagcgccgccacggcuauuuauugccugauggggucuggacagcuucugugggacaccgugacaggcguggauauggcccucuga

SEQ ID NO: 212828 - RNA, 1401 nt, Artificial Sequence; identical to SEQ ID NO: 212794
  derived and/or modified sequence opt5 from neuraminidase__InfluenzaB__AGX23890

SEQ ID NO: 212829 - RNA, 1401 nt, Artificial Sequence; identical to SEQ ID NO: 211812
  derived and/or modified sequence opt5 from neuraminidase__InfluenzaB__AGX23901

SEQ ID NO: 212830 - RNA, 1401 nt, Artificial Sequence
  derived and/or modified sequence opt5 from neuraminidase__InfluenzaB__AGX23912
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauagacugcggcaucugauuagcgucaaacucggcaagauccccaccguggagaacucuauuuuccacauggcugccugguccgggagcgcuugccaugauggaaaggaauggacauauguuggcguggacgggccugauucuaaugcccugcuuaaaaucaaguacggagaggcguacaccgacacguaucacuccuacgccaaaaacauucugcgcacacaagaaagcgcuuguaauugcaucggcggggauuguuaucucaugauuaccgacggacccgccuccggcaucucugagugcagauuucugaagauccgggagggccgcauuaucaaagaaauuuucccgacagggagagucaagcacaccgaggaauguaccugcggauuugcuagcaacaagacaaucgagugugccugccgggauaauuccuacacggccaaacgcccuuucgugaaacuuaacguugaaaccgacacagcugagauuagacugaugugcaccgagacauaucucgauacgccccggccuaaugacggcagcaucaccgggcccuguggaucugauggcgacaagggguccggaggcaucaagggcggguuugugcaucagcgcauggcgagcaaaauuggaagaugguacucucggacaaugagcaagaccaaaagaaugggcauggggcuguaugucaaguacgacggagaucccuggaccgacuccgaagcccuggcucucucuggcgugauggugagcauggaugagccugggugguacuccuucggcuuugaaaucaaggacaaaaagugcgaugucccguguauuggaaucgagaugguucacgacggcgggaaaacaaccuggcauagcgccgccacagcuauuuauugccugaugggaucuggccagcuucugugggauacggugaccgggguggacauggcccucuga

SEQ ID NO: 212831 - RNA, 1401 nt, Artificial Sequence; identical to SEQ ID NO: 211984
  derived and/or modified sequence opt5 from neuraminidase__InfluenzaB__AGX23934

SEQ ID NO: 212832 - RNA, 1401 nt, Artificial Sequence
  derived and/or modified sequence opt5 from neuraminidase__InfluenzaB__AGX23945
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgccaagaacauucugcggacacaagaaagcgcuuguaauugcaucggcggggauuguuaucucaugauuaccgacggacccgccuccggcaucucugagugccgcuuucugaaaaucagagagggccggauuaucaaggaaauuuucccgacagggcgcaucaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccuguggaucugauggcgacaagggguccggaggcauuaaaggcggguuuguucaucagcggauggcgagcaagaucggacgcugguacucuagaacaaugagcaaaaccaagcggaugggcauggggcuguaugugaaguacgacggagaucccuggaccgacuccgaagcccuggcucucucuggcgucauggugagcauggaugagccugggugguacuccuucggcuuugaaauuaaagacaagaaaugcgaugugccguguaucggaauugagaugguccacgacggcgggaagacaaccuggcauagcgccgccacagcuaucuauugccugaugggaucuggccagcuucugugggauacgguuaccgggguggacauggcccucuga

SEQ ID NO: 212833 - RNA, 1401 nt, Artificial Sequence
  derived and/or modified sequence opt5 from neuraminidase__InfluenzaB__AGX23956
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcauugacgggccugauucuaaugcccugcuuaagaucaaauacggagaggcguacaccgacacguaucacuccuacgccaagaacauucugcggacacaagaaagcgcuuguaauugcaucggcggggauuguuaucucaugaucaccgacggacccgccuccggcguuucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcauggaggaaccuggcugguacuccuucggguuugaaauuaaagauaagaaaugcgacgugccguguaucggcauugagaugguccacgauggaggcaagacaaccuggcauagcgccgccacagcuaucuauugccugauggggucuggacagcuucugugggacacgguuaccggcguggauauggcccucuga

SEQ ID NO: 212834 - RNA, 1401 nt, Artificial Sequence; identical to SEQ ID NO: 212171
  derived and/or modified sequence opt5 from neuraminidase__InfluenzaB__AGX23967

SEQ ID NO: 212835 - RNA, 1401 nt, Artificial Sequence; identical to SEQ ID NO: 211984
  derived and/or modified sequence opt5 from neuraminidase__InfluenzaB__AGX23978

SEQ ID NO: 212836 - RNA, 1401 nt, Artificial Sequence
  derived and/or modified sequence opt5 from neuraminidase__InfluenzaB__AGX23989
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaaucgguacacggccaagcgcccuuucgucaaacuuaacguggaaaccgacaaggcugagaucagacugaugugcacagagaccuaucucgauacaccccggccuaaugacggcuccaucaccgggcccugugaaagcgauggagacaaaggcucugggggaauuaagggcggcuuuguucaucagcgcauggcguccaaaaucgggagaugguacagccggacgaugucuaagacaaagagaaugggaaugggccuguaugugaaauacgacggggaucccuggaccgacagcggagcccuggcucucuccggcgucauggugucuauugaggaaccugggugguacagcuucggcuuugagaucaaggauaaaaagugcgacgugccguguauuggaaucgaaaugguccacgauggcgggaaaaccacauggcauuccgccgccaccgcuaucuauugccugaugggaagcggccagcuucugugggacacaguuacggggguggauauggcccucuga

SEQ ID NO: 212837 - RNA, 1401 nt, Artificial Sequence; identical to SEQ ID NO: 212794
  derived and/or modified sequence opt5 from neuraminidase__InfluenzaB__AGX24000

SEQ ID NO: 212838 - RNA, 1401 nt, Artificial Sequence
  derived and/or modified sequence opt5 from neuraminidase__InfluenzaB__AGX24011
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauuaugccaacgcgucuaauguucaggcugugaaccacagcgccgccaaaggagugacacugcuucugcccgaaccugaguggaccuaccccagacucuccugcccuggcagcacauuccagaaggcucugcuuaucucuccccaucgguuuggggaaaccaaaggaaauuccgccccucugauuauccgcgagccguucaucgcuuguggccccacggaaugcaagcacuuugcccucacccauuaugcggcccagccugggggauacuauaacggcacaagagaggaccggaauaaacugcgccaccugauuagcgucaagcucggcaagauccccaccguggagaacucuauuuuccauauggcugccugguccgggagcgcuugucacgauggaaaagaauggacauacaucggcguugacgggccugauucuaaugcccugcuuaagauuaaauacggagaggcguauaucgacaccuaccacuccuaugccaagaacauucugagaacgcaagaaagcgcuugcaauuguaucggcggggauugcuaccucaugaucacagacggacccgccuccggcauuucugagugucgguuucugaaaauccgcgagggcagaauuaucaaggaaauuuucccgaccgggcgggugaagcauacagaggaaugcaccuguggauuugcuagcaacaaaaccaucgagugcgccugucgcgauaauuccuauacagccaagagaccuuucgucaaacuuaacguggaaacggacaccgcugagauccggcugaugugcacagagaccuaccucgauacaccccgcccuaaugacggcagcauuaccgggcccugcgaaucugauggagacaagggcuccgggggaaucaaaggcggcuuuguucaccagagaauggcgagcaagauugggcggugguauucucgcacgaugagcaaaacaaagagaaugggaaugggccuguacgugaaguacgacggggaucccuggaccgacuccgaggcccuggcucucucuggagucauggugagcauggaggaaccuggcugguauuccuucggguuugaaaucaaagauaagaaaugugacgugccgugcauuggcaucgagaugguccaugauggaggcaagaccacauggcacagcgccgccaccgcuaucuacugucugauggggucuggacagcuucugugggacacaguuacgggcguggauauggcccucuga

SEQ ID NO: 212839 - RNA, 1401 nt, Artificial Sequence; identical to SEQ ID NO: 211984
  derived and/or modified sequence opt5 from neuraminidase__InfluenzaB__AGX24022

SEQ ID NO: 212840 - RNA, 1401 nt, Artificial Sequence
  derived and/or modified sequence opt5 from neuraminidase__InfluenzaB__AGX24033
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcucagauuaugccucucgauugcgccaacgcgucuaauguucaggcugugaacagaagcgccgccaaaggagugacacugcuucugccggaacccgaguggaccuauccucggcucuccugucccggcagcacauuccagaaggcucugcuuaucucuccucaccgcuuuggggaaaccaaaggaaauuccgcuccccugauuaucagagagccuuucaucgccugcggcccgacggaauguaagcauuuugcccucacccacuacgcggcccaacccgggggauauuacaacggcacacgggaggaccgcaauaaacugagacaucugauuagcgucaagcucggcaagaucccuaccguggagaacucuauuuuccacauggcugccugguccgggagcgcuugccaugauggaaaagaauggacauauaucggcguugacgggcccgauucuaaugcccugcuuaagauuaaauacggagaggcguacaccgacacguaucacuccuacgccaagaacauccugcggacacaggaaagcgcuuguaauugcauuggcggggauuguuaucucaugaucaccgacggaccugccuccggcaucucugagugccgcuuucugaaaauuagagagggccggaucauuaaggaaaucuuccccacagggcgcgugaagcacaccgaggaauguaccugcggauuugcuagcaacaaaacaauugagugugccugcagagauaaucgguacacggccaagcgcccguucgucaaacuuaacguggaaaccgacaaggcugagaucagacugaugugcacagagaccuaucucgauacaccucggcccaaugacggcuccaucaccgggccuugugaaagcgauggagacaaaggcucugggggaauuaagggcggcuuuguucaucagcgcauggcguccaaaaucgggagaugguacagccggacgaugucuaagacaaagagaaugggaaugggccuguaugugaaauacgacggggaucccuggaccgacagcggagcccuggcucucuccggcgucauggugucuauugaggaacccgggugguacagcuucggcuuugagaucaaggauaaaaagugcgacgugccuuguauuggaaucgaaaugguccacgauggcgggaaaaccacauggcauuccgccgccaccgcuaucuauugccugaugggaagcggccagcuucugugggacacaguuacggggguggauauggcccucuga

SEQ ID NO: 212841 - RNA, 1401 nt, Artificial Sequence; identical to SEQ ID NO: 211984
  derived and/or modified sequence opt5 from neuraminidase__InfluenzaB__AGX24044

SEQ ID NO: 212842 - RNA, 1401 nt, Artificial Sequence
  derived and/or modified sequence opt5 from neuraminidase__InfluenzaB__AGX24055
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacccugcuucugcccgaacucgaguggacauauccucggcuguccugucccggcagcaccuuccagaaggcccuucugaucucuccucaccgcuuuggggaaacgaaaggaaauuccgcuccccucauuaucagagagccuuucgucgccugcggcccgaccgaauguaagcauuuugcucugacacacuacgccgcgcagcccgggggauauuacaacggcacccgggaggaccgcaauaaacugagacaucucaucagcgugaagcugggcaagauuccuacaguugagaacucuaucuuccacauggccgcuugguccgggagcgccugccaugauggaaaagaauggaccuauauuggcguggacgggcccaauucuaacgcccuucugaagaucaaauacggagaggcuuacacggauacauaucacuccuacgcgaagaauauucuccggacccaagaaagcgccuguaacugcaucggcggggacuguuaucugaugauuacagauggaccugcuuccggcgucucugagugccgcuuucuuaaaaucagagagggccggaucauuaaggaaaucuuccccaccgggcgcgugaagcacaccgaggaauguacaugcggauuugccagcaauaaaacgauugagugugcuugcagagacaacuccuacaccgccaagcggccguucguuaaacugaauguggaaacagauaccgccgagauccgccucaugugcacagagaccuaucuggacacgccuagacccaacgauggcagcauuacagggccuugugaaucugacggagauaagggcuccgggggaaucaaaggcggcuuuguccaucagcggauggcuagcaagaucgggcgcugguacucuagaaccaugagcaaaaccaagcggaugggaaugggccuguaugugaaguacgacggggaccccuggacagauuccgaggcgcucgcccugucuggagugauggucagcauggaggaacccggcugguacuccuucggguuugaaauuaaagacaagaaaugcgauguuccuuguaucggcauugagauggugcacgacggaggcaagaccacauggcauagcgcugccacggccaucuauugccuuauggggucuggacagcugcucugggauaccgugacaggcgucgacauggcucuguga

SEQ ID NO: 212843 - RNA, 1401 nt, Artificial Sequence; identical to SEQ ID NO: 211841
  derived and/or modified sequence opt5 from neuraminidase__InfluenzaB__AGX24066

SEQ ID NO: 212844 - RNA, 1401 nt, Artificial Sequence
  derived and/or modified sequence opt5 from neuraminidase__InfluenzaB__AGX24077
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcgggaacuguuaucucaugaucaccgauggacccgccuccggcaucucugagugccgcuuucugaaaauuagagagggccggaucauuaaggaaaucuucccgacagggcgcgugaagcacaccgaggaauguaccugcggauuugcuagcaauaaaacaauugagugugccugcagagacaaccgguacacggccaagcgcccuuucgucaaacuuaauguggaaaccgauaaggcugagaucagacugaugugcacagagaccuaucucgacacaccccggccuaacgauggcuccaucaccgggcccugugaaagcgacggagauaaaggcucugggggaauuaagggcggcuuuguucaucagcgcauggcguccaaaaucgggagaugguacagccggacgaugucuaagacaaagagaaugggaaugggccuguaugugaaauacgacggggaccccugggccgauagcggagcucuggcccucuccggcgucauggugucuauugaggaaccugggugguacagcuucggcuuugagaucaaggacaaaaagugcgaugugccguguauuggaaucgaaaugguccacgacggcgggaaaaccaccuggcauuccgccgcuacagccaucuauugccugaugggaagcggccagcuucugugggauaccguuacagggguggacauggcgcucuga

SEQ ID NO: 212845 - RNA, 1401 nt, Artificial Sequence
  derived and/or modified sequence opt5 from neuraminidase__InfluenzaB__AGX24088
augcugcccagcaccauccagacacucacgcuguucauuaccuccggcggggugcuucugucucucuacgucagcgccucccugucuuaucuucuguacagcgacauccuccugaaguuuucccaaacagagauuaccgcuccuaucaugccgcuggauugcgccaacgcgucuaauguucaggcugugaacagaagcgccgccaaaggagugacacuccugcuucccgaaccugaguggaccuauccccggcuguccuguccuggcagcacauuccagaaggcucuccugauuucuccccaccgcuuuggggaaaccaaaggaaauuccgccccucuuaucaucagagagccguucauugcuugcggccccacggaauguaagcauuuugcccugacccacuacgcggcccagccugggggauauuacaacggcacacgggaggaccgcaauaaacucagacaucugaucagcgucaagcugggcaagauucccaccguggagaacucuaucuuccacauggcugccugguccgggagcgcuugccaugauggaaaagaauggacauauguuggcguggacgggccugauucugacgcccuccugaagauuaaauacggagaggcguacaccgauacguaucacuccuacgccaagaauauccuucggacacaagaaagcgcuuguaacugcauuggcggggacuguuaucugaugaucaccgauggacccgccuccggcaucucugagugccgcuuucucaaaauuagagagggccggaucauuaaggaaaucuucccgacagggcgcgucaagcacaccgaggaauguaccugcggauuugcuagcaauaaaacaauugagugugccugcagagacaacuccuacacggccaagcggccuuucgugaaacugaauguugaaaccgauacagcugagauccgccuuaugugcaccgagacauaucuggacacccccagaccuaacgauggcagcaucacggggcccuguggaucugacggcgacaagggguccggaggcauuaaaggcggguuugugcaucagcggauggcgagcaagaucggacgcugguacucuagaacaaugagcaaaaccaagcggaugggcauggggcucuaugucaaguacgauggagaccccuggaccgauuccgaagcccuggcucugucuggcgugauggugagcauggacgagccugggugguacuccuucggcuuugaaauuaaagauaagaaaugcgacgucccguguaucggaauugagaugguucacgauggcgggaagacaaccuggcauagcgccgccacagcuaucuauugccucaugggaucuggccagcugcuuugggacacggugaccgggguggauauggcccuguga

SEQ ID NO: 212846 - RNA, 1401 nt, Artificial Sequence; identical to SEQ ID NO: 211984
  derived and/or modified sequence opt5 from neuraminidase__InfluenzaB__AGX24099

SEQ ID NO: 212847 - RNA, 1401 nt, Artificial Sequence
  derived and/or modified sequence opt5 from neuraminidase__InfluenzaB__AGX24110
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauguuggcguggacgggccugauucuaaugcccugcuuaagaucaaauacggagaggcguacaccgacacguaucacuccuacgccaagaacauucugcggacacaagaaagcgcuuguaauugcaucggcggggauuguuaucucaugauuaccgacggacccgccuccggcaucucugagugccgcuuucugaaaaucagagagggccggauuaucaaggaaauuuucccgacagggcgcgucaagcacaccgaggaauguaccugcggauuugcuagcaacaaaacaaucgaguguacgugcagagauaauuccuacaccgccaagcggccuuucgugaaacuuaacguugaaacagacaccgccgagauucgccugaugugcacagagaccuaucucgauacgcccagaccuaaugacggcagcaucacagggcccuguggaucugauggcgacaagggguccggaggcaucaaaggcggguuugugcaucagcggauggcuagcaagauuggacgcugguacucuagaaccaugagcaaaaccaagcggaugggcauggggcuguaugucaaguacgacggagaucccuggacagacuccgaagcgcuggcccucucuggcgugauggugagcauggaugagccugggugguacuccuucggcuuugaaaucaaagacaagaaaugcgaugucccguguauuggaaucgagaugguucacgacggcgggaagaccacauggcauagcgcugccacggccauuuauugccugaugggaucuggccagcuucugugggauaccgugacagggguggacauggcucucuga

SEQ ID NO: 212848 - RNA, 1401 nt, Artificial Sequence
  derived and/or modified sequence opt5 from neuraminidase__InfluenzaB__AGX24121
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauuaugccaacgcgucuaauguucaggcugugaaccacagcgccgccaaaggagugacacugcuucugcccgaaccugaguggaccuaccccagacucuccugcccuggcagcacauuccagaaggcucugcuuaucucuccccaucgguuuggggaaaccaaaggaaauuccgccccucugauuauccgcgagccguucaucgcuuguggccccacggaaugcaagcacuuugcccucacccauuaugcggccaaaccugggggauacuauaacggcacaagagaggaccggaauaagcugcgccaccugauuagcgucaagcucggcaaaauccccaccguggagaacucuauuuuccauauggcugccugguccgggagcgcuugucacgauggaaaggaauggacauacaucggcguugacgggccugauucuaaugcccugcuuaaaauuaaguacggagaggcguauaccgacacguaccacuccuaugccaaaaacauccugagaacacaggaaagcgcuugcaauuguauuggcggggauugcuaccucaugaucaccgacggacccgccuccggcaucucugagugucgguuucugaagauucgcgagggcagaaucauuaaggaaaucuucccgacagggcgggugaaacauaccgaggaaugcaccuguggauuugcuagcaacaagacaauugagugcgccugucgcgauaauuccuauacggccaaaagaccuuucgucaaacuuaacguggaaaccgacacagcugagauccggcugaugugcaccgagacauaccucgauacgccccgcccuaaugacggcagcaucaccgggcccugcgaaucugauggagacaagggcuccgggggaauuaagggcggcuuuguucaccaaagaauggcgagcaaaaucgggcggugguauucucgcacaaugagcaagaccaagagaaugggaaugggccuguacgugaaauacgacggggaucccuggaccgacuccgaggcccuggcucucucuggagucauggugagcauggaggaaccuggcugguauuccuucggguuugaaauuaaggauaaaaagugugacgugccgugcaucggcauugagaugguccaugauggaggcaaaacaaccuggcacagcgccgccacagcuaucuacugucugauggggucuggacagcuucugugggacacgguuaccggcguggauauggcccucuga

SEQ ID NO: 212849 - RNA, 1401 nt, Artificial Sequence
  derived and/or modified sequence opt5 from neuraminidase__InfluenzaB__AGX24132
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugccccuuccugaacccgaguggacauauccucgccuguccugucccggcagcaccuuccagaaggcccuccugaucucuccucacagauuuggggaaacgaaaggaaauuccgcuccgcuuauuauccgggagcccuucaucgccugcggcccuaaggaauguaaacauuuugcucugacccacuacgccgcgcagcccgggggauauuacaacggcacacgcgaggacagaaauaagcuccggcaucugauuagcgucaagcugggcaaaaucccuaccguggagaacucuauuuuccacauggccgcuugguccgggagcgccugccaugauggacgcgaauggacauauaucggcguugacgggcccgauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggaccggcucucggcaucuccgagugccgguuucugaaaauucgcgagggcagaaucauuaaggaaaucuucccuacagggcgggugaagcacaccgaggaauguaccugcggauuugccucuaacaaaacaauugagugugcuugccgcgauaauagcuacacggccaagagacccuucgucaaacuuaacguggaaaccgacacagccgagauccggcugaugugcaccgagacauaucucgauaccccucgccccaaugacggcuccaucacggggcccugugaaagcaacggagauaagggcucugggggaauuaaaggcggcuuuguucaucaaagaauggcuuccaagaucgggcggugguacagcagaacaaugucuaaaaccaagcgcaugggaaugggccuguaugugaaguacgacggggacccuuggaccgauagcgaggcgcuggcccucuccggagucauggugucuauggaggaaccgggcugguacagcuucggguuugaaauuaaagacaagaaaugcgaugugcccuguaucggcauugagaugguccacgacggaggcaagacaaccuggcauuccgcugccacagccaucuauugccugauggggagcggacagcuucugugggauacgguuaccggcgugaauaugacacucuga

SEQ ID NO: 212850 - RNA, 1401 nt, Artificial Sequence
  derived and/or modified sequence opt5 from neuraminidase__InfluenzaB__AGX24143
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauggaaaugcccugcuuaagauuaaauacggcgaggcguacaccgacacguaucacucuuacgccaagaacauccugcggacacaagaauccgcuuguaauugcauugggggagauuguuaucucaugaucaccgacggccccgccagcggcaucuccgagugccgcuuucugaaaauuagagaggggcggaucauuaaggaaaucuucccgacaggacgcgugaagcacaccgaggaauguaccugcggcuuugcuucuaacaaaacaauugagugugccugcagagauaauagcuacacggccaagcggccuuucgucaaacuuaacguggaaaccgacacagcugagauccgccugaugugcaccgagacauaucucgauacccccagaccuaaugacggguccaucacgggacccugugaaagcgauggcgacaaggggucuggaggcauuaaaggcggguuuguucaucagcggauggcguccaagaucggacgcugguacagcagaacaaugucuaaaaccaagcggaugggcauggggcuguaugugaaguacgacggagaucccuggaccgacagcgaggcccuggcucucuccggcgucauggugucuauggaggaaccugggugguacagcuucggcuuugaaauuaaagauaagaaaugcgacgugccguguaucggaauugagaugguccacgauggcgggaagacaaccuggcauuccgccgccacagcuaucuauugccugaugggaagcggccagcuucugugggacacgguuaccgggguggauauggcccucuga

SEQ ID NO: 212851 - RNA, 1401 nt, Artificial Sequence; identical to SEQ ID NO: 211984
  derived and/or modified sequence opt5 from neuraminidase__InfluenzaB__AGX24154

SEQ ID NO: 212852 - RNA, 1401 nt, Artificial Sequence
  derived and/or modified sequence opt5 from neuraminidase__InfluenzaB__AGX24165
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauuaugccaacgcgucuaauguucaggcugugaaccacagcgccgccaaaggagugacacugcuucugcccgaaccugaguggaccuaccccagacucuccugcccuggcagcacauuccagaaggcucugcuuaucucuccccaucgguuuggggaaaccaaaggaaauuccgccccucugauuauccgcgagccguucaucgcuuguggccccacggaaugcaagcacuuugcccucacccauuaugcggcccagccugggggauacuauaacggcacaagagaggaccggaauaaacugcgccaccugauuagcgucaagcucggcaagauccccaccguggagaacucuauuuuccauauggcugccugguccgggagcgcuugucacgauggaaaagaauggacauacaucggcguugacgggccugauucuaaugcccugcuuaagauuaaauacggagaggcguauaccgacacguaccacuccuaugccaagaacauccugagaacacaagaaagcgcuugcaauuguauuggcggggauugcuaccucaugaucaccgacggacccgccuccggcaucucugagugucgguuucugaaaauucgcgagggcagaaucauuaaggaaaucuucccgacagggcgggugaagcauaccgaggaaugcaccuguggauuugcuagcaacaaaacaauugagugcgccugucgcgauaauuccuauacggccaagagaccuuucgucaaacuuaacguggaaaccgacacagcugagauccggcugaugugcaccgagacauaccucgauacgccccgcccuaaugacggcagcaucaccgggcccugcgaaucugauggagacaagggcuccgggggaauuaaaggcggcuuuguucaccagagaauggcgagcaagaucgggcggugguauucucgcacaaugagcaaaaccaagagaaugggaaugggccuguacgugaaguacgacggggaucccuggaccgacuccgaggcccuggcucucaacggagucauggugucuauggaggaaccuggcugguauagcuucggguuugaaauuaaagauaagaaaugugacgugccgugcaucggcauugagaugguccaugauggaggcaagacaaccuggcacuccgccgccacagcuaucuacugucugauggggagcggacagcuucugugggacacgguuaccggcguggauauggcccucuga

SEQ ID NO: 212853 - RNA, 1401 nt, Artificial Sequence; identical to SEQ ID NO: 211841
  derived and/or modified sequence opt5 from neuraminidase__InfluenzaB__AGX24176

SEQ ID NO: 212854 - RNA, 1401 nt, Artificial Sequence; identical to SEQ ID NO: 211841
  derived and/or modified sequence opt5 from neuraminidase__InfluenzaB__AGX24187

SEQ ID NO: 212855 - RNA, 1401 nt, Artificial Sequence; identical to SEQ ID NO: 211841
  derived and/or modified sequence opt5 from neuraminidase__InfluenzaB__AGX24198

SEQ ID NO: 212856 - RNA, 1401 nt, Artificial Sequence; identical to SEQ ID NO: 212171
  derived and/or modified sequence opt5 from neuraminidase__InfluenzaB__AGX24231

SEQ ID NO: 212857 - RNA, 1401 nt, Artificial Sequence; identical to SEQ ID NO: 211841
  derived and/or modified sequence opt5 from neuraminidase__InfluenzaB__AGX24242

SEQ ID NO: 212858 - RNA, 1401 nt, Artificial Sequence
  derived and/or modified sequence opt5 from neuraminidase__InfluenzaB__AGX24275
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacagaacaauugagugugccugccgggauaauuccuacacggccaaacgcccuuucgucaaacuuaacguggaaaccgacacagcugagaucagacugaugugcaccgagacauaucucgauacgccccggccuaaugacggcagcaucaccgggcccugugaaucugauggagacaagggcuccgggggaauuaagggcggcuuuguucaucagcgcauggcgagcaaaaucgggagaugguacucucggacaaugagcaagaccagacgcaugggaaugggccuguaugugaaauacgacggggaucccuggaccgacuccgaggcccuggcucucucuggagucauggugagcauggaggaaccuggcugguacuccuucggguuugaaauuaaggauaagaaaugcgacgugccguguaucggcauugagaugguccacgauggaggcaagacaaccuggcauagcgccgccacagcuaucuauugccugauggggucuggacagcuucugugggacacgguuaccggcguggauauggcccucuga

SEQ ID NO: 212859 - RNA, 1401 nt, Artificial Sequence; identical to SEQ ID NO: 212436
  derived and/or modified sequence opt5 from neuraminidase__InfluenzaB__AGX24286

SEQ ID NO: 212860 - RNA, 1401 nt, Artificial Sequence
  derived and/or modified sequence opt5 from neuraminidase__InfluenzaB__AGX24297
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccagaggaaauuccgccccucugauuauccgggagccguucaucgcuugcggccccacggaauguaaacauuuugcccucacccacuacgcggcccagccugggggauauuacaacggcacacgcgaggacagaaauaagcugcggcaucugauuagcgucaaacucggcaagauccccaccguggagaacucuauuuuccacauggcugccugguccgggagcgcuugccaugauggaaaggaauggacauauaucggcguugacgggccugauucuaaugcccugcuuaaaauuaaguacggagaggcguacaccgacacguaucacuccuacgccaaaaacauccugcgcacacaagaaagcgcuuguaauugcauuggcggggauuguuaucucaugaucaccgacggacccgccuccggcaucucugagugcagauuucugaagauucgggagggccgcaucauuaaagaaaucuucccgacagggagagugaagcacaccgaggaauguaccugcggauuugcuagcaacaagacaauugagugugccugccgggauaauuccuacacggccaaacgcccuuucgucaaacuuaacguggaaaccgacacagcugagaucagacugaugugcaccgagacauaucucgauacgccccggccuaaugacggcagcaucaccgggcccugugaaucugauggagacaagggcuccgggggaauuaagggcggcuuuguucaucagcgcauggcgagcaaaaucgggagaugguacucucggacaaugagcaagaccaaaagaaugggaaugggccuguaugugaaguacgacggggaucccuggaccgacuccgaggcccuggcucucucuggagucauggugagcauggaggaaccuggcugguacuccuucggguuugaaauuaaggauaaaaagugcgacgugccguguaucggcauugagaugguccacgauggaggcaaaacaaccuggcauagcgccgccacagcuaucuauugccugauggggucuggacagcuucugugggacacgguuaccggcguggauauggcccucuga

SEQ ID NO: 212861 - RNA, 1401 nt, Artificial Sequence; identical to SEQ ID NO: 212436
  derived and/or modified sequence opt5 from neuraminidase__InfluenzaB__AGX24319

SEQ ID NO: 212862 - RNA, 1401 nt, Artificial Sequence
  derived and/or modified sequence opt5 from neuraminidase__InfluenzaB__AGX24330
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauuaugccaacgcgucuaauguucaggcugugaaccacagcgccgccaaaggagugacacugcuucugcccgaaccugaguggaccuaccccagacucuccugcccuggcagcacauuccagaaggcucugcuuaucucuccccaucgguuuggggaaaccaaaggaaauuccgccccucugauuauccgcgagccguucaucgcuuguggccccacggaaugcaagcacuuugcccucacccauuaugcggcccagccugggggauacuauaacggcacaagagaggaccggaauaaacugcgccaccugauuagcgucaagcucggcaagauccccaccguggagaacucuauuuuccauauggcugccugguccgggagcgcuugucacgauggaaaagaauggacauacaucggcguugacgggccugauucuaaugcccugcuuaagauuaaauacggagaggcguauaccgacacguaccacuccuaugccaagaacauccugagaacacaagaaagcgcuugcaauuguauuggcggggauugcuaccucaugaucaccgacggacccgccuccggcaucucugagugucgguuucugaaaauucgcgagggcagaaucauuaaggaaaucuucccgacagggcgggugaagcauaccgaggaaugcaccuguggauuugcuagcaacaaaacaauugagugcacgugucgcgauaauuccuauaccgccaagagaccuuucgucaaacuuaacguggaaacagacaccgccgagauccggcugaugugcacagagaccuaccucgauacgccccgcccuaaugacggcagcaucacagggcccugcgaaucugauggagacaagggcuccgggggaauuaaaggcggcuuuguucaccagagaauggcuagcaagaucgggcggugguauucucgcaccaugagcaaaaccaagagaaugggaaugggccuguacgugaaguacgacggggaucccuggacagacuccgaggcgcuggcccucucuggagucaugauuagcauggaggaaccuggcugguauuccuucggguuugaaaucaaagauaagaaaugugacgugccgugcauuggcaucgagauggugcaugauggaggcaagaccacaugguacagcgcugccacggccaucuauugucugauggggucuggacagcuucugugggacaccgucacaggcguugauauggcucucuga

SEQ ID NO: 212863 - RNA, 1401 nt, Artificial Sequence
  derived and/or modified sequence opt5 from neuraminidase__InfluenzaB__AGX24341
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucuaacggagauaagggcuccgggggaauuaaaggcggcuuuguucaucaaagaauggcuagcaagaucgggcggugguacucuagaacaaugagcaaaaccaagcgcaugggaaugggccuguaugugaaguacgacggggaccccuggaccgauuccgaggcgcugacacucucuggagucauggugagcauggaggaaccuggcugguacuccuucggguuugaaauuaaagacaagaaaugcgaugugccguguaucggcauugagaugguccacgacggaggcaagaccacauggcauagcgccgcuacggccaucuauugccugauggggucuggacagcuucugugggauaccguuacaggcgugaauaugacccucuga

SEQ ID NO: 212864 - RNA, 1401 nt, Artificial Sequence
  derived and/or modified sequence opt5 from neuraminidase__InfluenzaB__AGX24352
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauaauaacgcucugcuuaagauuaaauacggagaggccuacaccgacacguaucacucuuacgcgaagaauauccugagaacacaggaauccgccuguaacugcauuggcggggauuguuaucucaugaucaccgacggacccgcuagcggcaucuccgagugccgguuucugaaaauucgcgagggcagaaucauuaaggaaaucuucccgacagggcgggugaagcacaccgaggaauguaccugcggauuugccucuaauaaaacaauugagugugcuugccgcgauaacagcuacacggccaagagaccuuucgucaaacuuaauguggaaaccgacacagccgagauccggcugaugugcaccgagacauaucucgauacgccccgcccuaacgacggcuccaucaccgggcccugugaaagcaauggagauaagggcucugggggaauuaaaggcggcuuuguucaucaaagaauggcuuccaagaucgggcggugguacagcagaacaaugucuaaaaccaagcgcaugggaaugggccuguaugugaaguacgacggggaccccuggaccgauagcgaggcgcuggcccucuccggagucauggugucuauggaggaaccuggcugguacagcuucggguuugaaauuaaagacaagaaaugcgaugugccguguaucggcauugagaugguccacgacggaggcaagacaaccuggcauuccgcugccacagccaucuauugccugauggggagcggacagcuucugugggauacgguuaccggcgugaacaugacacucuga

SEQ ID NO: 212865 - RNA, 1401 nt, Artificial Sequence; identical to SEQ ID NO: 212860
  derived and/or modified sequence opt5 from neuraminidase__InfluenzaB__AGX24363

SEQ ID NO: 212866 - RNA, 1401 nt, Artificial Sequence; identical to SEQ ID NO: 212864
  derived and/or modified sequence opt5 from neuraminidase__InfluenzaB__AGX24374

SEQ ID NO: 212867 - RNA, 1401 nt, Artificial Sequence
  derived and/or modified sequence opt5 from neuraminidase__InfluenzaB__AGX24385
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuacaaugccgcucgauugcgccaacgcgucuaauguucaagcugugaaccggagcgccaccaaaggagugacacugcuucugcccgaaccugaguggaccuauccccgccucuccuguccuggcagcacguuccagaaggcccugcuuauuucuccccacagauuuggggaaaccaaaggaaauuccgcuccucugaucauucgggagccguucaucgccugcggccccaaggaauguaaacauuuugcucucacacacuacgccgcgcagccugggggauauuacaacggcacccgcgaggacagaaauaagcugcggcaucugaucagcgucaagcucggcaaaauucccacaguggagaacucuaucuuccacauggccgcuugguccgggagcgccugccaugauggacgcgaauggaccuauauuggcguugacgggccugauucuaaugcucugcuuaagaucaaauacggagaggccuacacggacacauaucacuccuacgcgaagaacauucugagaacccaggaaagcgccuguaauugcaucggcggggauuguuaucucaugauuacagacggacccgcuuccggcaucucugagugccgguuucugaaaauccgcgagggcagaauuaucaaggaaauuuucccgaccgggcgggugaagcacaccgaggaauguacaugcggauuugccagcaacaaaacgaucgagugugcuugccgcgauaauuccuacaccgccaagagaccuuucgucaaacuuaacguggaaacagacaccgccgagauucggcugaugugcacagagaccuaucucgauacgccccgcccuaaugacggcagcaucacagggcccugugaaucuaacggagauaagggcuccgggggaaucaaaggcggcuuuguucaucaaagaauggcuagcaagauugggcggugguacucuagaaccaugagcaaaaccaagcgcaugggaaugggccuguaugugaaguacgacggggaccccuggacagauuccgaggcgcuggcccucucuggagucauggugagcauggaggaaccuggcugguacuccuucggguuugaaaucaaagacaagaaaugcgaugugccguguauuggcaucgagaugguccacgacggaggcaagaccacauggcauagcgcugccacggccauuuauugccugauggggucuggacagcuucugugggauaccguuacaggcgugaauaugacccucuga

SEQ ID NO: 212868 - RNA, 1401 nt, Artificial Sequence
  derived and/or modified sequence opt5 from neuraminidase__InfluenzaB__AGX24396
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaaucgguacacggccaagcgcccuuucgucaaacuuaacguggaaaccgacacagcugagaucagacugaugugcaccgagacauaucucgauacgccccggccuaaugacggcuccaucaccgggcccugugaaagcgauggagacaagggcucugggggaauuaaaggcggcuuuguucaucagcgcauggcguccaagaucgggagaugguacagccggacaaugucuaaaaccaagagaaugggaaugggccuguaugugaaguacgacggggaucccuggaccgacagcggagcccuggcucucuccggcgucauggugucuauugaggaaccugggugguacagcuucggcuuugagaucaaagauaagaaaugcgacgugccguguauuggaaucgaaaugguccacgauggcgggaagacaaccuggcauuccgccgccacagcuaucuauugccugaugggaagcggccagcuucugugggacacgguuaccgggguggauauggcccucuga

SEQ ID NO: 212869 - RNA, 1401 nt, Artificial Sequence; identical to SEQ ID NO: 212868
  derived and/or modified sequence opt5 from neuraminidase__InfluenzaB__AGX24407

SEQ ID NO: 212870 - RNA, 1401 nt, Artificial Sequence; identical to SEQ ID NO: 211841
  derived and/or modified sequence opt5 from neuraminidase__InfluenzaB__AGX24418

SEQ ID NO: 212871 - RNA, 1401 nt, Artificial Sequence; identical to SEQ ID NO: 211812
  derived and/or modified sequence opt5 from neuraminidase__InfluenzaB__AGX24429

SEQ ID NO: 212872 - RNA, 1401 nt, Artificial Sequence
  derived and/or modified sequence opt5 from neuraminidase__InfluenzaB__AGX24440
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggcacgaccgaauguaagcauuuugcccucacacacuacgcggcccagcccgggggauauuacaacggcacccgggaggaccgcaauaaacugagacaucugauuagcgucaagcucggcaagaucccuacaguggagaacucuauuuuccacauggcugccugguccgggagcgcuugccaugauggaaaagaauggaccuauaucggcguugacgggcccgauucuaaugcccugcuuaagauuaaauacggagaggcguacacggacacauaucacuccuacgccaagaacauccugcggacccaagaaagcgcuuguaauugcauuggcggggauuguuaucucaugaucacagacggaccugccuccggcaucucugagugccgcuuucugaaaauuagagagggccggaucauuaaggaaaucuuccccaccgggcgcgugaagcacaccgaggaauguacaugcggauuugcuagcaacaaaacgauugagugugccugcagagauaaucgguacaccgccaagcgcccguucgucaaacuuaacguggaaacagacaccgcugagaucagacugaugugcacagagaccuaucucgauacgccucggcccaaugacggcuccaucacagggccuugugaaagcgauggagacaagggcucugggggaauuaaaggcggcuuuguucaucagcgcauggcguccaagaucgggagaugguacagccggaccaugucuaaaaccaagagaaugggaaugggccuguaugugaaguacgacggggaucccuggacagacagcggagcccuggcucucuccggcgucauggugucuauugaggaacccgggugguacagcuucggcuuugagaucaaagauaagaaaugcgacgugccuuguauuggaaucgaaaugguccacgauggcgggaagaccacauggcauuccgccgccacgaccaucuauugccugaugggaagcggccagcuucugugggacacaguuaccgggguggauauggcucucuga

SEQ ID NO: 212873 - RNA, 1401 nt, Artificial Sequence; identical to SEQ ID NO: 212436
  derived and/or modified sequence opt5 from neuraminidase__InfluenzaB__AGX24451

SEQ ID NO: 212874 - RNA, 1401 nt, Artificial Sequence
  derived and/or modified sequence opt5 from neuraminidase__InfluenzaB__AGX24462
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauuaugccaacgcgucuaauguucaggcugugaaccacagcgccgccaaaggagugacacugcuucugcccgaaccugaguggaccuaccccagacucuccugcccuggcagcacauuccagaaggcucugcuuaucucuccccaucgguuuggggaaaccaaaggaaauuccgccccucugauuauccgcgagccguucaucgcuuguggccccacggaaugcaagcacuuugcccucacccauuaugcggcccagccugggggauacuauaacggcacaagagaggaccggaauaaacugcgccaccugauuagcgucaagcucggcaagauccccaccguggagaacucuauuuuccauauggcugccugguccgggagcgcuugucacgauggaaaagaauggacauacaucggcguugacgggccugauucuaaugcccugcuuaagauuaaauacggagaggcguauaccgacacguaccacuccuaugccaagaacauccugagaacacaagaaagcgcuugcaauuguauuggcggggauugcuaccucaugaucaccgacggacccgccuccggcaucucugagugucgguuucugaaaauucgcgagggcagaaucauuaaggaaaucuucccgacagggcgggugaagcauaccgaggaaugcaccuguggauuugcuagcaacaaaacaauugagugcgccugucgcgauaauuccuauacggccaagagaccuuucgucaaacuuaacguggaaaccgacacagcugagauccggcugaugugcaccgagacauaccucgauacgccccgcccuaaugacggcagcaucaccgggcccugcgaaucugauggagacaagggcuccgggggaauuaaaggcggcuuuguucaccagagaauggcgagcaagaucgggcggugguauucucgcacaaugagcaaaaccaagagaaugggaaugggccuguacgugaaguacgacggggaucccuggaccgacuccgaggcccuggcucucucuggagucaugauuagcauggaggaaccuggcugguauuccuucggguuugaaaucaaagauaagaaaugugacgugccgugcauuggcaucgagauggugcaugauggaggcaagacaaccuggcacagcgccgccacagcuaucuacugucugauggggucuggacagcuucugugggacacggucaccggcguugauauggcccucuga

SEQ ID NO: 212875 - RNA, 1401 nt, Artificial Sequence; identical to SEQ ID NO: 212874
  derived and/or modified sequence opt5 from neuraminidase__InfluenzaB__AGX24473

SEQ ID NO: 212876 - RNA, 1401 nt, Artificial Sequence
  derived and/or modified sequence opt5 from neuraminidase__InfluenzaB__AGX24484
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauggcuacacggccaagcggccuuucgucaaacuuaacguggaaaccgacacagcugagauccgccugaugugcaccgagacauaucucgauacccccagaccuaaugacggguccaucacgggacccugugaaagcgauggcgacaaggggucuggaggcauuaaaggcggguuuguucaucagcggauggcguccaagaucggacgcugguacagcagaacaaugucuaaaacccggagaaugggcauggggcuguaugugaaguacgacggagaucccuggaccgacagcgaggcccuggcucucuccggcgucauggugucuauggaggaaccugggugguacagcuucggcuuugaaauuaaggauaaaaagugcgacgugccguguaucggaauugagaugguccacgauggcgggaaaacaaccuggcauuccgccgccacagcuaucuauugccugaugggaagcggccagcuucugugggacacgguuaccgggguggauauggcccucuga

SEQ ID NO: 212877 - RNA, 1401 nt, Artificial Sequence
  derived and/or modified sequence opt5 from neuraminidase__InfluenzaB__AGX24495
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucagguggugaacagaagcgcugccaaaggagucacacugcuucugcccgaaccugaguggaccuauccccggcucuccuguccuggcagcacauuccagaaggcccugcuuaucucuccccaccgcuuuggggaaaccaaaggaaauuccgcuccucugauuaucagagagccguucaucgccugcggccccacggaauguaagcauuuugcucucacccacuacgccgcgcagccugggggauauuacaacggcacacgggaggaccgcaauaaacugagacaucugauuagcgugaagcucggcaagauccccaccguugagaacucuauuuuccacauggccgcuugguccgggagcgccugccaugauggaaaagaauggacauauaucggcguggacgggccugauucuaaugcucugcuuaagauuaaauacggagaggccuacaccgacacguaucacuccuacgcgaagaacauccugcggacacaagaaagcgccuguaauugcauuggcggggauuguuaucucaugaucaccgacggacccgcuuccggcaucucugagugccgcuuucugaaaauuagagagggccggaucauuaaggaaaucuucccgacagggcgcgucaagcacaccgaggaauguaccugcggauuugccagcaacaaaacaauugagugugcuugcagagauaauuccuacacggccaagcggccuuucgugaaacuuaacguugaaaccgacacagccgagauccgccugaugugcaccgagacauaucucgauacccccagaccuaaugacggcagcaucacggggcccugugaaucugauggagacaagggcuccgggggaauuaaaggcggcuuugugcaucagcggauggcuagcaagaucgggcgcugguacucuagaacaaugagcaaaacccggagaaugggaaugggccuguaugucaaguacgacggggaucccuggaccgacuccgaggcgcuggcccucucuggagugauggugagcauggaggaaccuggcugguacuccuucggguuugaaauuaaggauaaaaagugcgacgucccguguaucggcauugagaugguucacgauggaggcaaaacaaccuggcauagcgcugccacagccaucuauugccugauggggucuggacagcuucugugggacacggugaccggcguggauauggcucucuga

SEQ ID NO: 212878 - RNA, 1401 nt, Artificial Sequence; identical to SEQ ID NO: 212436
  derived and/or modified sequence opt5 from neuraminidase__InfluenzaB__AGX24506

SEQ ID NO: 212879 - RNA, 1401 nt, Artificial Sequence
  derived and/or modified sequence opt5 from neuraminidase__InfluenzaB__AGX24517
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccgccaaaggagugacacugcuucugcccgaaccugaguggaccuaucccagacucuccuguccuggcagcacauuccagaaggcucugcuuaucucuccccaucgguuuggggaaaccaaaggaaauuccgccccucugauuauccgcgagccguucaucgcuugcggccccacggaauguaagcacuuugcccucacccauuacgcggcccagccugggggauauuacaacggcacaagagaggaccggaauaaacugcgccaccugauuagcgucaagcucggcaagauccccaccguggagaacucuauuuuccauauggcugccugguccgggagcgcuugccacgauggaaaagaauggacauauaucggcguugacgggccugauucuaaugcccugcuuaagauuaaauacggagaggcguacaccgacacguaucacuccuacgccaagaacauccugagaacacaagaaagcgcuuguaauugcauuggcggggauuguuaucucaugaucaccgacggacccgccuccggcgugucugagugccgguuucugaaaauccgcgagggcagaauuaucaaggaaauuuucccgacagggcgggucaagcauaccgaggaauguaccugcggauuugcuagcaacaaaacaaucgagugugccugccgcgauaauuccuacacggccaagagaccuuucgugaaacuuaacguugaaaccgacacagcugagauucggcugaugugcaccgagacauaucucgauacgccccgcccuaaugacggcagcaucaccgggcccugugaaucugauggagacaagggcuccgggggaaucaaaggcggcuuugugcaccagagaauggcgagcaagauugggcggugguacucucgcacaaugagcaaaaccaagagaaugggaaugggccuguaugucaaguacgacggggaucccuggaccgacuccgaggcccuggcucucucuggagugauggugagcauggaggaaccuggcugguacuccuucggguuugaaaucaaagauaagaaaugcgacgucccguguauuggcaucgagaugguucaugauggaggcaagacaaccuggcacagcgccgccacagcuauuuauugccugauggggucuggacagcuucugugggacacggugaccggcguggauauggcccucuga

SEQ ID NO: 212880 - RNA, 1401 nt, Artificial Sequence; identical to SEQ ID NO: 212436
  derived and/or modified sequence opt5 from neuraminidase__InfluenzaB__AGX24528

SEQ ID NO: 212881 - RNA, 1401 nt, Artificial Sequence; identical to SEQ ID NO: 212864
  derived and/or modified sequence opt5 from neuraminidase__InfluenzaB__AGX24539

SEQ ID NO: 212882 - RNA, 1401 nt, Artificial Sequence
  derived and/or modified sequence opt5 from neuraminidase__InfluenzaB__AGX24550
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuuauccccgaaccugaguggaccuauccccggcuguccuguccuggcagcacauuccagaaggcucuccugauuucuccccaccgcuuuggggaaaccaaaggaaauuccgccccucuuaucaucagagagccguucauugcuugcggccccacggaauguaagcauuuugcccugacccacuacgcggcccagccugggggauauuacaacggcacacgggaggaccgcaauaaacucagacaucugaucagcgucaagcugggcaagauucccaccguggagaacucuaucuuccacauggcugccugguccgggagcgcuugccaugauggaaaagaauggacauauauuggcguugacgggccugauucuaaugcccuccugaagaucaaauacggagaggcguacaccgacacguaucacuccuacgccaagaacauucuucggacacaagaaagcgcuuguaauugcaucggcggggauuguuaucugaugaucaccgacggacccgccuccggcauuucugagugccgcuuucucaaaaucagagagggccggauuaucaaggaaauuuucccgacagggcgcgugaagcacaccgaggaauguaccugcggauuugcuagcaacaaaacaaucgagugugccugcagagauaauuccuacacggccaagcggccuuucgucaaacugaacguggaaaccgacacagcugagauccgccuuaugugcaccgagacauaucuggauacccccagaccuaaugacggcagcauuacggggcccugugaaucugauggagacaagggcuccgggggaaucaaaggcggcuuuguucaucagcggauggcgagcaagauugggcgcugguacucuagaacaaugagcaaaaccaagcggaugggaaugggccucuaugugaaguacgacggggaucccuggaccgacuccgaggcccuggcucugucuggagucauggugagcauggaggaaccuggcugguacuccuucggguuugaaaucaaagauaagaaaugcgacgugccguguauuggcaucgagaugguccacgauggaggcaagacaaccuggcauagcgccgccacagcuaucuauugccucauggggucuggacagcugcuuugggacacgguuaccggcguggauauggcccuguga

SEQ ID NO: 212883 - RNA, 1401 nt, Artificial Sequence; identical to SEQ ID NO: 212874
  derived and/or modified sequence opt5 from neuraminidase__InfluenzaB__AGX24561

SEQ ID NO: 212884 - RNA, 1401 nt, Artificial Sequence; identical to SEQ ID NO: 211841
  derived and/or modified sequence opt5 from neuraminidase__InfluenzaB__AGX24572

SEQ ID NO: 212885 - RNA, 1401 nt, Artificial Sequence
  derived and/or modified sequence opt5 from neuraminidase__InfluenzaB__AGX24583
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaacccggagaaugggaaugggccuguaugugaaguacgacggggaucccuggaccgacuccggagcccuggcucucucuggcgucauggugagcauugaggaaccugggugguacuccuucggcuuugagaucaaggauaaaaagugcgacgugccguguauuggaaucgaaaugguccacgauggcgggaaaacaaccuggcauagcgccgccacagcuaucuauugccugaugggaucuggccagcuucugugggacacgguuaccgggguggauauggcccucuga

SEQ ID NO: 212886 - RNA, 1401 nt, Artificial Sequence; identical to SEQ ID NO: 212436
  derived and/or modified sequence opt5 from neuraminidase__InfluenzaB__AGX24594

SEQ ID NO: 212887 - RNA, 1401 nt, Artificial Sequence; identical to SEQ ID NO: 212436
  derived and/or modified sequence opt5 from neuraminidase__InfluenzaB__AGX24605

SEQ ID NO: 212888 - RNA, 1401 nt, Artificial Sequence; identical to SEQ ID NO: 212436
  derived and/or modified sequence opt5 from neuraminidase__InfluenzaB__AGX24616

SEQ ID NO: 212889 - RNA, 1401 nt, Artificial Sequence; identical to SEQ ID NO: 212860
  derived and/or modified sequence opt5 from neuraminidase__InfluenzaB__AGX24627

SEQ ID NO: 212890 - RNA, 1401 nt, Artificial Sequence; identical to SEQ ID NO: 212436
  derived and/or modified sequence opt5 from neuraminidase__InfluenzaB__AGX24638

SEQ ID NO: 212891 - RNA, 1401 nt, Artificial Sequence
  derived and/or modified sequence opt5 from neuraminidase__InfluenzaB__AGX24660
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucaccuacuaugccgcgcagccugggggauacuauaacggcacacgcgaggacagaaauaagcugcggcaccugauuagcgucaagcucggcaaaauccccaccguggagaacucuauuuuccauauggccgcuugguccgggagcgccugccacgauggacgcgaauggacauacaucggcguugacgggccugauucuaaugcucugcuuaagauuaaauacggagaggccuauaccgacacguaccauuccuaugcgaagaacauccugagaacacaggaaagcgccuguaauugcauuggcggggauuguuaccucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuauacggccaagagaccuuucgucaaacuuaacguggaaaccgacacagccgagauccggcugaugugcaccgagacauaccucgauacgccccgcccuaaugacggcagcaucaccgggcccugugaaucuaacggagauaagggcuccgggggaauuaaaggcggcuuuguucaccaaagaauggcuagcaagaucgggcggugguauucuagaacaaugagcaaaaccaagcgcaugggaaugggccuguacgugaaguacgacggggaccccuggaccgauuccgaggcgcuggcccucucuggagucauggugagcauggaggaaccuggcugguauuccuucggguuugaaauuaaagacaagaaaugcgaugugccguguaucggcauugagaugguccaugacggaggcaagacaaccuggcacagcgcugccacagccaucuacugccugauggggucuggacagcuucugugggauacgguuaccggcgugaauaugacacucuga

SEQ ID NO: 212892 - RNA, 1401 nt, Artificial Sequence
  derived and/or modified sequence opt5 from neuraminidase__InfluenzaB__AGX24671
augcugcccagcaccauccagacacucacgcuguuccuuaccuccggcggggugcugcuccugcuuuacgucucugccagccuguccuaucuccuguacucugacauucugcucaaguuuagccaaacagagaucaccgcuccuauuaugccgcuggauugcgccaacgcguccaauguucaggcugugaacagaucugccgccaaaggagugacacuucugcuccccgaaccugaguggaccuauccccggcugagcuguccuggcuccacauuccagaaggcccuucugaucagcccccaccgcuuuggggaaaccaaaggaaauucugcuccucucauuaucagagagccguucaucgcuugcggccccacggaauguaagcauuuugcccugacccacuacgcggcccagccugggggauauuacaacggcacacgggaggaccgcaauaaacugagacaucucauuuccgucaagcugggcaagauccccaccguggagaacagcauuuuccacauggcugccuggucuggguccgcuugccaugauggaaaagaauggacauauaucggcguugacgggccugauagcaaugcccuucugaagauuaaauacggagaggcguacaccgacacguaucacucuuacgccaagaacauccuccggacacaagaauccgcuuguaauugcauuggcggggauuguuaucugaugaucaccgacggacccgccagcggcaucuccgagugccgcuuucuuaaaauuagagagggccggaucauuaaggaaaucuucccgacagggcgcgugaagcacaccgaggaauguaccugcggauuugcuucuaacaaaacaauugagugugccugcagagauaauagcuacacggccaagcggccuuucgucaaacugaacguggaaaccgacacagcugagauccgccucaugugcaccgagacauaucuggauacccccagaccuaaugacggcuccaucacggggcccugugaaagcgauggagacaagggcucugggggaauuaaaggcggcuuuguucaucagcggauggcguccaagaucgggcgcugguacagcagaacaaugucuaaaaccaagcggaugggaaugggccuguaugugaaguacgacggggaucccuggaccgacagcgaggcccucgcucuguccggagucauggugucuauggaggaaccuggcugguacagcuucggguuugaaauuaaagauaagaaaugcgacaucccguguauuggcaucgagauggugcacgauggaggcaagacaaccuggcauuccgccgccacagcuaucuauugccuuauggggagcggacagcugcucugggacacggucaccggcguugauauggcccuguga

SEQ ID NO: 212893 - RNA, 1401 nt, Artificial Sequence
  derived and/or modified sequence opt5 from neuraminidase__InfluenzaB__AGX24682
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucuaacggagauaagggcuccgggggaauuaaaggcggcuuuguucaucaaagaauggcuagcaagaucgggcggugguacucuagaacaaugagcaaaaccaagcgcaugggaaugggccuguaugugaaguacgacggggaccccuggaccgauuccgaggcgcugguccucucuggagugauggugagcauggaggaaccuggcugguacuccuucggguuugaaauuaaagacaagaaaugcgaugucccguguaucggcauugagaugguucacgacggaggcaagacaaccuggcauagcgccgcuacagccaucuauugccugauggggucuggacagcuucugugggauacggugaccggcgugaauaugacacucuga

SEQ ID NO: 212894 - RNA, 1401 nt, Artificial Sequence; identical to SEQ ID NO: 212436
  derived and/or modified sequence opt5 from neuraminidase__InfluenzaB__AGX24693

SEQ ID NO: 212895 - RNA, 1401 nt, Artificial Sequence; identical to SEQ ID NO: 212436
  derived and/or modified sequence opt5 from neuraminidase__InfluenzaB__AGX24704

SEQ ID NO: 212896 - RNA, 1401 nt, Artificial Sequence; identical to SEQ ID NO: 212436
  derived and/or modified sequence opt5 from neuraminidase__InfluenzaB__AGX24715

SEQ ID NO: 212897 - RNA, 1401 nt, Artificial Sequence
  derived and/or modified sequence opt5 from neuraminidase__InfluenzaB__AGX24737
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggcacgaccgaauguaagcauuuugcccucacacacuacgcggcccagcccgggggauauuacaacggcacccgggaggaccgcaauaaacugagacaucugauuagcgucaagcucggcaagaucccuacaguggagaacucuauuuuccacauggcugccugguccgggagcgcuugccaugauggaaaagaauggaccuauaucggcguugacgggcccgauucuaaugcccugcuuaagauuaaauacggagaggcguacacggacacauaucacuccuacgccaagaacauccugcggacccaagaaagcgcuuguaauugcauuggcggggauuguuaucucaugaucacagacggaccugccuccggcaucucugagugccgcuuucugaaaauuagagagggccggaucauuaaggaaaucuuccccaccgggcgcgugaagcacaccgaggaauguacaugcggauuugcuagcaacaaaacgauugagugugccugcagagauaaucgguacaccgccaagcgcccguucgucaaacuuaacguggaaacagacaccgcugagaucagacugaugugcacagagaccuaucucgauacgccucggcccaaugacggcuccaucacagggccuugugaaagcgauggagacaagggcucugggggaauuaaaggcggcuuuguucaucagcgcauggcguccaagaucgggagaugguacagccggaccaugucuaaaaccaagagaaugggaaugggccuguaugugaaguacgacggggaucccuggacagacagcggagcccuggcucucuccggcgucauggugucuauugaggaacccgggugguacagcuucggcuuugagaucaaagauaagaaaugcgacgugccuuguauuggaaucgaaaugguccacgauggcgggaagaccacauggcauuccgccgccacggcuaucuauugccugaugggaagcggccagcuucugugggacaccguuacagggguggauauggcccucuga

SEQ ID NO: 212898 - RNA, 1401 nt, Artificial Sequence
  derived and/or modified sequence opt5 from neuraminidase__InfluenzaB__AGX24748
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggcgguauuacaacggaacacgcgaggacagaaauaaacugcggcaucugauuagcgucaagcucggcaagauccccaccguggagaacucuauuuuccacauggcugccugguccggcagcgcuugccaugaugggaaagaauggacauauaucggaguugacggcccugauucuaaugcccugcuuaagauuaaauacggggaggcguacaccgacacguaucacuccuacgccaagaacauccugcgcacacaagaaagcgcuuguaauugcauuggaggcgauuguuaucucaugaucaccgacgggcccgccuccggaaucucugagugcagauuucugaaaauucgggagggccgcaucauuaaggaaaucuucccgacaggcagagugaagcacaccgaggaauguaccugcggguuugcuagcaacaaaacaauugagugugccugccgggauaauuccuacacggccaagcgcccuuucgucaaacuuaacguggaaaccgacacagcugagaucagacugaugugcaccgagacauaucucgauacgccccggccuaaugacggaagcaucaccggccccugugaaucugauggggacaagggauccggcgggauuaaaggaggcuuuguucaucagcgcauggcgagcaagaucggcagaugguacucucggacaaugagcaaaaccaagagaauggggaugggacuguaugugaaguacgacggcgaucccuggaccgacuccgaggcccuggcucucucuggggucauggugagcauggaggaaccuggaugguacuccuucggcuuugaaauuaaagauaagaaaugcgacgugccguguaucgggauugagaugguccacgauggcggaaagacaaccuggcauagcgccgccacagcuguuuauugccugaugggcucugggcagcuucugugggacacggugaccggaguggauauggcccucuga

SEQ ID NO: 212899 - RNA, 1401 nt, Artificial Sequence
  derived and/or modified sequence opt5 from neuraminidase__InfluenzaB__AGX24759
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcauggaggaaccuggcugguacuccuucggguuugaaauuaaagauaagaaaugcgacaucccguguauuggcaucgagauggugcacgauggaggcaagacaaccuggcauagcgccgccacagcuaucuauugccugauggggucuggacagcuucugugggacacggucaccggcguugauauggcccucuga

SEQ ID NO: 212900 - RNA, 1401 nt, Artificial Sequence; identical to SEQ ID NO: 212436
  derived and/or modified sequence opt5 from neuraminidase__InfluenzaB__AGX24770

SEQ ID NO: 212901 - RNA, 1401 nt, Artificial Sequence; identical to SEQ ID NO: 212898
  derived and/or modified sequence opt5 from neuraminidase__InfluenzaB__AGX24781

SEQ ID NO: 212902 - RNA, 1401 nt, Artificial Sequence; identical to SEQ ID NO: 211812
  derived and/or modified sequence opt5 from neuraminidase__InfluenzaB__AGX24792

SEQ ID NO: 212903 - RNA, 1401 nt, Artificial Sequence; identical to SEQ ID NO: 212860
  derived and/or modified sequence opt5 from neuraminidase__InfluenzaB__AGX24803

SEQ ID NO: 212904 - RNA, 1401 nt, Artificial Sequence; identical to SEQ ID NO: 212436
  derived and/or modified sequence opt5 from neuraminidase__InfluenzaB__AGX24814

SEQ ID NO: 212905 - RNA, 1401 nt, Artificial Sequence
  derived and/or modified sequence opt5 from neuraminidase__InfluenzaB__AGX24825
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccuggggaguauuacaacggaacacgggaggaccgcaauaaacugagacaucugauuagcgucaagcucggcaagauccccaccguggaaaacucuauuuuccacauggcugccugguccggcagcgcuugccaugaugggaaagaguggacauauaucggaguugacggcccugauucuaaugcccugcuuaagauuaaauacggggaagcguacaccgacacguaucacuccuacgccaagaacauccugcggacacaagagagcgcuuguaauugcauuggaggcgauuguuaucucaugaucaccgacgggcccgccuccggaaucucugagugccgcuuucugaaaauuagagaaggccggaucauuaaggagaucuucccgacaggccgcgugaagcacaccgaagaguguaccugcggguuugcuagcaacaaaacaauugaaugugccugcagagauaauuccuacacggccaagcggccuuucgucaaacuuaacguggagaccgacacagcugagauccgccugaugugcaccgaaacauaucucgauacccccagaccuaaugacggaagcaucacgggccccugugagucugauggggacaagggauccggcgggauuaaaggaggcuuuguucaucagcggauggcgagcaagaucggccgcugguacucuagaacaaugagcaaaacccggagaauggggaugggacuguaugugaaguacgacggcgaucccuggaccgacuccgaagcccuggcucucucuggggucauggugagcauggaggaaccuggaugguacuccuucggcuuugagauuaaggauaaaaagugcgacgugccguguaucgggauugagaugguccacgauggcggaaaaacaaccuggcauagcgccgccacagcuaucuauugccugaugggcucugggcagcuucugugggacacgguuaccggaguggauauggcccucuga

SEQ ID NO: 212906 - RNA, 1401 nt, Artificial Sequence; identical to SEQ ID NO: 212436
  derived and/or modified sequence opt5 from neuraminidase__InfluenzaB__AGX24836

SEQ ID NO: 212907 - RNA, 1401 nt, Artificial Sequence
  derived and/or modified sequence opt5 from neuraminidase__InfluenzaB__AGX24847
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucuaacggagauaagggcuccgggggaauuaaaggcggcuuuguucaucaaagaauggcuagcaagaucgggcggugguacucuagaacaaugagcaaaaccaagcgcaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccacgacggaggcaagacaaccuggcauagcgcugccacagccguuuauugccugauggggucuggacagcuucugugggauacggugaccggcgugaauaugacacucuga

SEQ ID NO: 212908 - RNA, 1401 nt, Artificial Sequence; identical to SEQ ID NO: 211920
  derived and/or modified sequence opt5 from neuraminidase__InfluenzaB__AGX24858

SEQ ID NO: 212909 - RNA, 1401 nt, Artificial Sequence
  derived and/or modified sequence opt5 from neuraminidase__InfluenzaB__AGX24869
augcugcccagcaccauccagacacucacgcuguuccuuaccuccggcggggugcugcucucucuguacgucagcgccucccuuucuuaucugcucuacagcgacauucugcugaaguuuuccagaacagagaugaccgcuccuaucaugccgcucggaugcgccaacgcgucuaauguucaagcugugaaccggagcgccacaaaaggcgugacccugcuucugcccgaaccugaguggacauauccccgccucuccuguccugggagcaccuuccagaaggcccugcuuauuucuccccacagauuuggagaaacgaaaggcaauuccgcuccucugaucauucgggagccguucaucgccugcgggcccaaggaauguaaacauuuugcucucacccacuacgccgcgcagccuggaggcuauuacaacggcacacgcgaggauagaaauaagcugcggcaucugaucagcgucaagcucgggaaaauucccaccguggagaacucuaucuuccacauggccgcuugguccggaagcgccugccaugacggccgcgaauggacauauauugggguugauggaccugacucuaaugcucugcuuaagaucaaauacggcgaggccuacaccgauacguaucacuccuacgcgaagaacauucugagaacacaggaaagcgccuguaauugcaucgggggagacuguuaucucaugauuaccgauggccccgcuuccggcaucucugagugccgguuucugaaaauccgcgaggggagaauuaucaaggaaauuuucccgacaggacgggugaagcacaccgaggaauguaccugcggcuuugccagcaacaaaacaaucgagugugcuugccgcgacaauuccuacacggccaagagaccuuucgucaaacuuaacguggaaaccgauacagccgagauucggcugaugugcaccgagacauaucucgacacgccccgcccuaaugaugggagcaucaccggacccugugaaucuaacggcgacaagggguccggaggcaucaaaggcggguuuguucaucaaagaauggcuagcaagauuggacggugguacucuagaacaaugagcaaaaccaagcgcaugggcauggggcuguaugugaaguacgauggagaccccuggaccgacuccgaggcgcuggcccucucuggcgucauggugagcauggaggaaccugggugguacuccuucggcuuugaaaucaaagauaagaaaugcgacgugccguguauuggaaucgagaugguccacgauggcgggaagacaaccuggcauagcgcugccacagccauuuauugccugaugggaucuggccagcuucugugggacacgguuaccggggugaauaugacacucuga

SEQ ID NO: 212910 - RNA, 1401 nt, Artificial Sequence
  derived and/or modified sequence opt5 from neuraminidase__InfluenzaB__AGX24880
augcugcccagcaccauccagaugcucacacuguuccuuacguccggcggggugcugcucucucuguacgucagcgccucccuuucuuaucugcucuacagcgacauucugcugaaguuuuccagaaccgagaucacagcuccuauuaugccgcucgauugcgccaacgcgucuaauguucaagcugugaaccggagcgccaccaaaggagugacacugcuucugcccgaaccugaguggaccuauccccgccucuccuguccuggcagcacauuccagaaggcccugcuuaucucuccccacagauuuggggaaaccaaaggaaauuccgcuccucugauuauccgggagccguucaucgccugcggccccaaggaauguaaacauuuugcucucacgcacuacgccgcgcagccugggggauauuacaacggcacccgcgaggacagaaauaagcugcggcaucugauuagcgucaagcucggcaaaauccccacaguggagaacucuauuuuccacauggccgcuugguccgggagcgccugccaugauggacgcgaauggaccuauaucggcguugacgggccugauucuaaugcucugcuuaagauuaaauacggagaggccuacacagacaccuaucacuccuacgcgaagaacauccugagaacgcaggaaagcgccuguaauugcauuggcggggauuguuaucucaugaucacagacggacccgcuuccggcaucucugagugccgguuucugaaaauucgcgagggcagaaucauuaaggaaaucuucccgaccgggcgggugaagcacacagaggaauguaccugcggauuugccagcaacaaaaccauugagugugcuugccgcgauaauuccuacacagccaagagaccuuucgucaaacuuaacguggaaacggacaccgccgagauccggcugaugugcacagagaccuaucucgauacaccccgcccuaaugacggcagcaucaccgggcccugugaaucuaacggagauaagggcuccgggggaauuaaaggcggcuuuguucaucaaagaauggcuagcaagaucgggcggugguacucuagaacgaugagcaaaacaaagcgcaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccacgacggaggcaagaccacauggcauagcgcugccaccgccaucuauugccugauggggucuggacagcuucugugggauacaguuacgggcgugaauaugacccucuga

SEQ ID NO: 212911 - RNA, 1401 nt, Artificial Sequence
  derived and/or modified sequence opt5 from neuraminidase__InfluenzaB__AGX24902
augcugcccagcaccauccagacacucacgcuguuccuuaccuccggcggggugcugcucucucuguacgucagcgcccuucuguccuaucuccuguacucugacauucugcucaaguuuagcagaacagagaucaccgcuccuauuaugccgcuggauugcgccaacgcguccaauguucaagcugugaaccggucugccacaaaaggagugacccuucugcuccccgaaccugaguggacauauccccgccugagcuguccuggcuccaccuuccagaaggcccuucugaucagcccccacagauuuggggaaaauaaaggaaacucugcuccucucauuauccgggagccguucaucgccugcggccccaaggaauguaaacauuuugcucugacgcacuacgccgcgcagccugggggauauuacaauggcacccgcgaggacagaaacaagcugcggcaucucauuuccgucaagcugggcaaaauccccacaguggagaauagcauuuuccacauggccgcuuggucuggguccgccugccaugauggacgcgaauggaccuauaucggcguugacgggccugauagcaacgcccuucugaagauuaaauacggagaggcuuacacagacaccuaucacucuuacgcgaagaauauccucagaacgcaggaauccgccuguaacugcauuggcggggauuguuaucugaugaucacagacggacccgcuagcggcaucuccgagugccgguuucuuaaaauucgcgagggcagaaucauuaaggaaaucuucccgaccgggcgggugaagcacacagaggaauguaccugcggauuugccucuaauaaaaccauugagugugcuugccgcgauaacaauuacacagccaagagaccuuucgucaaacugaacguggaaacggacaccgccgagauccggcucaugugcacagagaccuaucuggauacaccccgcccuaaugacggcagcaucaccgggcccugugaauccaacggagauaagggcagcgggggaauuaaaggcggcuuuguucaucaaagaauggcuucuaagaucgggcggugguacuccagaacgaugagcaaaacaaagcgcaugggaaugggccuguaugugaaguacgacggggaccccuggaccgauucugaggcgcucgcccugagcggagucaugguguccauggaggaaccuggcugguacucuuucggguuugaaauuaaagacaagaaaugcgaugugccguguaucggcauugagaugguccacgacggaggcaagaccacauggcauagcgcugccaccgccaucuauugccuuaugggguccggacagcugcucugggauacaguuacgggcgugaacaugacccuguga

SEQ ID NO: 212912 - RNA, 1401 nt, Artificial Sequence; identical to SEQ ID NO: 211925
  derived and/or modified sequence opt5 from neuraminidase__InfluenzaB__AGX84846

SEQ ID NO: 212913 - RNA, 1401 nt, Artificial Sequence; identical to SEQ ID NO: 211980
  derived and/or modified sequence opt5 from neuraminidase__InfluenzaB__AGX84858

SEQ ID NO: 212914 - RNA, 1401 nt, Artificial Sequence; identical to SEQ ID NO: 211925
  derived and/or modified sequence opt5 from neuraminidase__InfluenzaB__AGX84869

SEQ ID NO: 212915 - RNA, 1401 nt, Artificial Sequence
  derived and/or modified sequence opt5 from neuraminidase__InfluenzaB__AGX84880
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugucucucgauugcgccaacgcgagcaauguucaagcugugaacagauccgccaccaaaggagugauuuuccugcuucccgaaccugaguggacauauccccggcugagcuguccuggcucuaccuuucagaaggcccuccugaucagcccccaccgcuucggggaaacgaaaggaaauuccgcuccucuuauuaucagagagccguuuaucgccugcggccccaacgaauguaagcauuucgcucugacccacuacgccgcgcagccugggggauauuacaauggcacacggggcgaccgcaacaaacucagacaucugauuucugucaagcuggggaagauccccaccguggaaaauuccauuuuucacauggccgcuuggagcggaucugccugccaugauggcaaagaguggacauauaucgggguugacggaccugauaacgacgcucuccugaaggugaaauacggcgaggccuacaccgauacguaucacuccuacgcgaauaagauucuucggacacaggagagcgccuguaacugcaucgggggaaauuguuaucugaugauuaccgacggcuccgcuucuggcgucagcgaaugccgcuuccucaaaaucagagaggggcggaucauuaaggagaucuuucccacaggacgcgugaagcacaccgaagaguguaccugcggcuucgccuccaacaaaacaauugaaugugcuugcagagauaauagcuacacggccaagcggccguuuguuaaacugaacguggagaccgacacagccgaaauccgccuuaugugcaccgauacauaucuggacaccccuagacccgaugacgggucuauuacgggaccuugugaguccaauggcgacaaggggagcggaggcaucaaaggcggguucguccaucaacggauggagucuaagaucggacgcugguacagcagaacaauguccaaaaccgaacggaugggcauggggcucuaugugaaguacgauggagaccccugggcugauucugacgcgcuggccuuuagcggcgugauggucuccaugaaggagcccgggugguacagcuucggcuucgaaauuaaagauaagaaaugcgacguuccuuguaucggaauugagauggugcacgauggcgggaaggaaaccuggcauucugcugccacagccaucuauugccugaugggauccggccagcuccugugggacaccgugacaggggucgauauggcucuuuga

SEQ ID NO: 212916 - RNA, 1401 nt, Artificial Sequence; identical to SEQ ID NO: 211925
  derived and/or modified sequence opt5 from neuraminidase__InfluenzaB__AGX84891

SEQ ID NO: 212917 - RNA, 1401 nt, Artificial Sequence; identical to SEQ ID NO: 211980
  derived and/or modified sequence opt5 from neuraminidase__InfluenzaB__AGX84902

SEQ ID NO: 212918 - RNA, 1401 nt, Artificial Sequence
  derived and/or modified sequence opt5 from neuraminidase__InfluenzaB__AGX84924
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauuaugccaacgcgucuaauguucaagcugugaacagaagcgccaccaaaggagugacauuccuucugcccgaaccugaguggaccuacccccggcucuccugcccuggcagcacguuucagaaggcccugcuuauuucuccccaccgcuucggggaaaccaaaggaaauuccgcuccucugaucauuagagagccguuuaucgccuguggccccaacgaaugcaagcauuucgcucucacacacuaugccgcgcagccugggggauacuauaauggcacccggggcgaccgcaacaaacugagacaucugaucagcgucaagcucgggaagauucccacaguggaaaauucuaucuuucacauggccgcuugguccggaagcgccugucaugauggcaaagaguggaccuacauugggguugacggaccugauaacgacgcucugcuuaaggugaaauacggcgaggccuauacggauacauaccacucuuaugcgaauaagauccugcggacccaggaguccgccugcaacuguauugggggaaauugcuaccucaugaucacagacggcagcgcuuccggcgucucugaaugucgcuuccugaaaauuagagaggggcggaucaucaaggagauuuuucccaccggacgcgugaagcacaccgaagagugcacauguggcuucgccagcaacaaaacgaucgaaugcgcuuguagagauaauuccuauaccgccaagcggccguuuguuaaacuuaacguggagacagacaccgccgaaauucgccugaugugcacagauaccuaccucgacacgccuagacccgaugacgggagcaucacaggaccuugcgagucuaauggcgacaagggguccggaggcauuaaaggcggguucguccaucaacggauggagagcaagaucggacgcugguauucuagaaccaugagcaaaaccgaacggaugggcauggggcuguacgugaaguacgauggagaccccugggcugauuccgacgcgcuggccuuuucuggcgugauggucagcaugaaggagcccgggugguauuccuucggcuucgaaaucaaagauaagaaaugugacguuccuugcauuggaaucgagauggugcacgauggcgggaaggaaacauggcauagcgcugccaccgccauuuacugucucaugggaucuggccagcugcuuugggacacagugacgggggucgauauggcucuguga

SEQ ID NO: 212919 - RNA, 1401 nt, Artificial Sequence
  derived and/or modified sequence opt5 from neuraminidase__InfluenzaB__AGY46393
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgaccaauguucaagcugugaacagaucugccacaaaaggagugacccugcuucugccugaacccgaguggacguauccucggcucagcugucccggcuccaccuuccagaaggcccugcuuauuagcccucaccgcuuuggggaaaucaaaggaaauucugcuccgcugauuaucagagagcccuucaucgccugcggcccuaacgaauguaagcauuuugcucucacacacuacgccgcgcagcccgggggauauuacaauggcacccgggaggaccgcaacaaacugagacaucugauuuccgucaagcucggcaagaucccuacaguggagaauagcauuuuccacauggccgcuuggucuggguccgccugccaugauggacgggaauggaccuauaucggcguugacgggcccgauagcaacgcucugcuuaaaauuaaguacggagaggccuacacggacacauaucacucuuacgcgaaaaauauccugcgcacccaggaauccgccuguaacugcauuggcggggauuguuaucucaugaucacagacggaccggcuagcggcaucuccgagugcagauuucugaagauucgggagggccgcaucauuaaagaaaucuucccuaccgggagagugaagcacaccgaggaauguacaugcggauuugccucuaauaagacgauugagugugcuugccgggauaacagcuacaccgccaaacgccccuucgucaaacuuaauguggaaacagacaccgccgagaucagacugaugugcacagagaccuaucucgauacgccucggcccaacgacggcuccaucacagggcccugugaaagcaauggagauaagggcucugggggaauuaagggcggcuuuguucaucaacgcauggcuuccaaaaucgggagaugguacagccggaccaugucuaagaccgagagaaugggaaugggccuguaugugaaauacgacggggacccuugggcggauagcgacgcccuggcuuucuccggagucauggugucuauggaggaaccgggcugguacagcuuuggguucgaaauuaaggauaagaaaugcgacgugcccuguaucggcauugagaugguccacgauggaggcaaggagacauggcauuccgccgccaccgcuaucuauugccucauggggagcggacagcugcuuugggacacaguuacgggcgugaacauggcccuguga

SEQ ID NO: 212920 - RNA, 1401 nt, Artificial Sequence
  derived and/or modified sequence opt5 from neuraminidase__InfluenzaB__AGY46397
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaacgaauguaagcauuuugcucucacccacuacgccgcgcagccugggggauauuacaauggcacacgcggcgacagaaacaaacugcggcaucugauuagcgucaagcucgggaagauccccaccguggaaaauucuauuuuccacauggccgcuugguccggaagcgccugccaugauggcaaagaguggacauauaucgggguugacggaccugauaacaaugcucugcuuaaggugaaauacggcgaggccuacaccgacacguaucacucuuacgcgaacaagauucugcgcacacaggaguccgccuguaauugcaucgggggaaacuguuaucucaugauuaccgauggcagcgcuuccggcgucucugaaugcagauuucugaaaauccgggaggggcgcaucauuaaggagaucuuccccacaggaagagugaagcacaccgaagaguguaccugcggcuuugccagcaauaaaacaauugaaugugcuugccgggacaacuccuacacggccaagcgcccguucguuaaacuuaauguggagaccgauacagccgaaaucagacugaugugcaccgacacauaucucgauaccccucggcccaacgacgggagcauuacgggaccuugugagucugauggcgacaagggguccggaggcaucaaaggcggguuuguccaucaacgcauggagagcaagaucggaagaugguacucucggacaaugagcaaaaccgaaagaaugggcauggggcuguaugugaaguacgacggagaucccugggcugacuccgaugcgcuggccuucucuggcgugauggucagcaugaaggagcccgggugguacuccuuuggcuucgaaauuaaagacaagaaaugcgauguuccuuguaucggaauugagauggugcacgacggcgggaagaccacauggcauagcgcugccaccgccaucuauugccucaugggaucuggccagcugcuuugggauacagugacgggggucaacaugacccuguga

SEQ ID NO: 212921 - RNA, 1401 nt, Artificial Sequence
  derived and/or modified sequence opt5 from neuraminidase__InfluenzaB__AGY46399
augcugcccagcaccauccagacacucacgcuguuccuuaccuccggcggggugcugcucucucuguacgucagcgccucccuuucuuaucugcucuacagcgacauucugcugaaguuuuccccuacagagaucauugcuccgaccacaccccucgauugcgccaacgcgucuaauguucaagcugugaacagaagcgccaccaaaggagugacacugcuucugccugaacccgaguggaccuauccucggcucuccugucccggcagcacguuccagaaggcccugcuuaucucuccucaccgcuuuggggaaaccaaaggaaauuccgcuccgcugauuaucagagagcccuucaucgccugcggcccuaaggaauguaaacauuuugcucucacacacuacgccgcgcagcccgggggauauuacaacggcacccgggaggaccgcaauaagcugagacaucugauuagcgucaagcucggcaaaaucccuacaguggagaacucuauuuuccacauggccgcuugguccgggagcgccugccaugauggacgggaauggaccuauaucggcguugacgggcccgauucuaaugcucugcuuaagauuaaauacggagaggccuacacggacacauaucacuccuacgcgaagaacauccugcgcacccaggaaagcgccuguaauugcauuggcggggauuguuaucucaugaucacagacggaccggcuuccggcaucucugagugcagauuucugaaaauucgggagggccgcaucauuaaggaaaucuucccuaccgggagagugaagcacaccgaggaauguacaugcggauuugccagcaacaaaacgauugagugugcuugccgggauaauuccuacaccgccaagcgccccuucgucaaacuuaacguggaaacagacaccgccgagaucagacugaugugcacagagaccuaucucgauacgccucggcccaaugacggcagcaucacagggcccugugaaucuaacggagauaagggcuccgggggaauuaaaggcggcuuuguucaucaacgcauggcuagcaagaucgggagaugguacucucggaccaugagcaaaaccaagagaaugggaaugggccuguaugugaaguacgacggggacccuugggcggauuccgaggcccuggcucucucuggagucauggugagcauggaggaaccgggcugguacuccuucggguuugaaauuaaagacaagaaaugcgaugugcccuguaucggcauugagaugguccacgacggaggcaaggagacauggcauagcgccgccaccgcuaucuauugccugauggggucuggacagcuucugugggauacaguuacgggcguggacauggcccucuga

SEQ ID NO: 212922 - RNA, 1401 nt, Artificial Sequence
  derived and/or modified sequence opt5 from neuraminidase__InfluenzaB__AGY46401
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggacgggaauggaccuauauuggcguugacgggcccgauucuaaugcucugcuuaagaucaaauacggagaggccuacacggacacauaucacuccuacgcgaagaacauucugcgcacccaggaaagcgccuguaauugcaucggcggggauuguuaucucaugauuacagacggaccggcuuccggcaucucugagugcagauuucugaaaauccgggagggccgcauuaucaaggaaauuuucccuaccgggagagugaagcacaccgaggaauguacaugcggauuugccagcaacaaaacgaucgagugugcuugccgggauaauuccuacaccgccaagcgccccuucgucaaacuuaacguggaaacagacaccgccgagauuagacugaugugcacagagaccuaucucgauacgccucggcccaaugacggcagcaucacagggcccugugaaucuaacggagauaagggcuccgggggaaucaaaggcggcuuuguucaucaacgcauggcuagcaagauugggagaugguacucucggaccaugagcaaaaccaagagaaugggaaugggccuguaugugaaguacgacggggacccuugggcggauuccgacgcccuggcuuucucuggagucauggugagcaugaaagagccgggcugguacuccuuuggguucgaaaucaaggauaaaaagugcgacgugcccuguauuggcaucgagaugguccacgauggaggcaaagaaacauggcauagcgccgccaccgcuauuuauugccucauggggucuggacagcugcuuugggacacaguuacgggcguggauauggcccuguga

SEQ ID NO: 212923 - RNA, 1401 nt, Artificial Sequence; identical to SEQ ID NO: 211640
  derived and/or modified sequence opt5 from neuraminidase__InfluenzaB__AGZ59825

SEQ ID NO: 212924 - RNA, 1401 nt, Artificial Sequence; identical to SEQ ID NO: 211706
  derived and/or modified sequence opt5 from neuraminidase__InfluenzaB__AGZ59836

SEQ ID NO: 212925 - RNA, 1401 nt, Artificial Sequence; identical to SEQ ID NO: 212395
  derived and/or modified sequence opt5 from neuraminidase__InfluenzaB__AGZ59847

SEQ ID NO: 212926 - RNA, 1401 nt, Artificial Sequence
  derived and/or modified sequence opt5 from neuraminidase__InfluenzaB__AGZ59858
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcaaacggggcgaccgcaacaagcugagacaccugaucagcgucaagcucgggaaaauuccuaccguggaaaauucuaucuuccauauggccgcuugguccggaagcgccugccacgauggcaaggaguggacauauauugggguugacggacccgauaacaaugcucugcuuaaaaucaaguacggcgaggccuacaccgacacguaucacucuuacgcgaacaauauucugcggacacaggaguccgccuguaacugcaucgggggaaauuguuaucucaugauuaccgauggcagcgcuuccggcgugucugaaugccgcuuucugaaaaucagagaggggcggaucauuaaggagaucuucccgacaggacgcgucaagcauaccgaagaguguaccugcggcuuugccagcaacaaaacaauugaaugugcuugcagagacaauuccuacacggccaagcggccuuucgugaaacuuaacguugagaccgauacagccgaaauccgccugaugugcaccgacacauaucucgauacccccagaccugacgaugggagcauuacgggacccugugagucuaacggcgacaagggguccggaggcaucaaaggcggguuugugcaccagcggauggcuagcaagaucggacgcugguacucuagaacaaugagcaaaaccgagcggaugggcauggggcuguaugucaaguacgacggagaucccugggcggacuccgaugcccuggcuuucucuggcgugauggugagcaugaaggaaccugggugguacuccuuuggcuucgagauuaaagacaagaaaugcgaugucccguguaucggaauugaaaugguucaugacggcgggaaggagaccuggcacagcgccgccacagcuaucuauugccucaugggaucuggccaacugcuuugggauaccgugacagggguggacauggcccuguga

SEQ ID NO: 212927 - RNA, 1401 nt, Artificial Sequence
  derived and/or modified sequence opt5 from neuraminidase__InfluenzaB__AGZ59869
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggccguccugauuucuccucaccgcuuuggggaaaccaaaggaaauuccgcuccgcuuaucauuagagagcccuucaucgccugcggcccuaacgaauguaagcauuuugcucugacacacuacgccgcgcagcccgggggauauuacaauggcacccggggcgaccgcaacaaacucagacaucugaucagcgugaagcuggggaagauuccuacaguugaaaauucuaucuuccacauggccgcuugguccggaagcgccugccaugauggcaaagaguggaccuauauugggguggacggacccgauaacaaugcucuccugaagaucaaauacggcgaggccuacacggacacauaucacucuuacgcgaacaagauucuucggacccaggaguccgccuguaauugcaucgggggaaacuguuaucugaugauuacagauggcagcgcuuccggcgucucugaaugccgcuuucucaaaaucagagaggggcggaucauuaaggagaucuucccgaccggacgcgugaagcacaccgaagaguguacaugcggcuuugccagcaauaaaacgauugaaugugcuugcagagacaacuccuacaccgccaagcggccuuucguuaaacugaauguggagacagauaccgccgaaauccgccuuaugugcacagacaccuaucuggauacgcccagaccugacgaugggagcauuacaggacccugugagucuaacggcgacaagggguccggaggcaucaaaggcggguuuguccaucaacggauggcuagcaagaucggacgcugguacucuagaaccaugagcaaaaccgagcggaugggcauggggcucuaugugaaguacgacggagaucccugggcggacuccgaugcccuggcuuucucuggcgugauggucagcaugaaggaaccugggugguacuccuuuggcuucgagauuaaagacaagaaaugcgauguuccguguaucggaauugaaauggugcacgacggcgggaaggagacauggcauagcgccgccaccgcuaucuauugccugaugggaucuggccagcuccugugggauacagugacgggggucgacauggcccuuuga

SEQ ID NO: 212928 - RNA, 1401 nt, Artificial Sequence; identical to SEQ ID NO: 212424
  derived and/or modified sequence opt5 from neuraminidase__InfluenzaB__AGZ59880

SEQ ID NO: 212929 - RNA, 1401 nt, Artificial Sequence; identical to SEQ ID NO: 212868
  derived and/or modified sequence opt5 from neuraminidase__InfluenzaB__AGZ59891

SEQ ID NO: 212930 - RNA, 1401 nt, Artificial Sequence; identical to SEQ ID NO: 211985
  derived and/or modified sequence opt5 from neuraminidase__InfluenzaB__AGZ59902

SEQ ID NO: 212931 - RNA, 1401 nt, Artificial Sequence; identical to SEQ ID NO: 211985
  derived and/or modified sequence opt5 from neuraminidase__InfluenzaB__AGZ59913

SEQ ID NO: 212932 - RNA, 1401 nt, Artificial Sequence; identical to SEQ ID NO: 211985
  derived and/or modified sequence opt5 from neuraminidase__InfluenzaB__AGZ59924

SEQ ID NO: 212933 - RNA, 1401 nt, Artificial Sequence; identical to SEQ ID NO: 211985
  derived and/or modified sequence opt5 from neuraminidase__InfluenzaB__AGZ59935

SEQ ID NO: 212934 - RNA, 1401 nt, Artificial Sequence; identical to SEQ ID NO: 211985
  derived and/or modified sequence opt5 from neuraminidase__InfluenzaB__AGZ59946

SEQ ID NO: 212935 - RNA, 1401 nt, Artificial Sequence
  derived and/or modified sequence opt5 from neuraminidase__InfluenzaB__AGZ59957
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcuggccuucucuggcgugauggucagcaugaaggagccugggugguacuccuuuggcuucgaaaucaaagauaagaaaugcgacguuccguguauuggaaucgagauggugcacgauggcgggaagggaacauggcauagcgcugccaccgccauuuauugccucaugggcucugggcagcugcuuugggacacagugacgggagucgauauggcucuguga

SEQ ID NO: 212936 - RNA, 1401 nt, Artificial Sequence; identical to SEQ ID NO: 211985
  derived and/or modified sequence opt5 from neuraminidase__InfluenzaB__AGZ59969

SEQ ID NO: 212937 - RNA, 1401 nt, Artificial Sequence; identical to SEQ ID NO: 211985
  derived and/or modified sequence opt5 from neuraminidase__InfluenzaB__AGZ59980

SEQ ID NO: 212938 - RNA, 1401 nt, Artificial Sequence; identical to SEQ ID NO: 211985
  derived and/or modified sequence opt5 from neuraminidase__InfluenzaB__AGZ59991

SEQ ID NO: 212939 - RNA, 1401 nt, Artificial Sequence; identical to SEQ ID NO: 211985
  derived and/or modified sequence opt5 from neuraminidase__InfluenzaB__AGZ60003

SEQ ID NO: 212940 - RNA, 1401 nt, Artificial Sequence
  derived and/or modified sequence opt5 from neuraminidase__InfluenzaB__AGZ60014
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaagcuaagggaaauuccgccccucugaucauucgggagccguuuaucgcuugcggccccaacgaauguaaacauuucgcccucacccacuacgcggcccagccugggggauauuacaauggcacacgcggcgacagaaacaagcugcggcaucugaucagcgucaaacucgggaagauucccaccguggaaaauucuaucuuucacauggcugccugguccggaagcgcuugccaugauggcaaggaguggacauauauugggguugacggaccugauaacgacgcccugcuuaaagugaaguacggcgaggcguacaccgauacguaucacucuuacgccaauaaaauccugcgcacacaggaguccgcuuguaacugcauugggggaaauuguuaucucaugaucaccgacggcagcgccuccggcgucucugaaugcagauuccugaagauucgggaggggcaaaucaucaaagagauuuuucccacaggacgcgugaagcacaccgaagaguguaccugcggcuucgcuagcaacaagacaaucgaaugugccugcagagauaauuccuacacggccaaacggccguuuguuaaacuuaacguggagaccgacacagcugaaauucgccugaugugcaccgauacauaucucgacaccccuagacccgaugacgggagcaucacgggaccuugugagucuaauggcgacaagggguccggaggcauuaagggcggguucguccaucagcggauggagagcaaaaucggacgcugguacucuagaacaaugagcaagaccgaacggaugggcauggggcuguaugugaaauacgauggagaccccugggcggauuccgacgcccuggcuuuuucuggcgugauggucagcaugaaggagcccgggugguacuccuucggcuucgaaaucaaggauaaaaagugcgacguuccuuguauuggaaucgagauggugcacgauggcgggaaagaaaccuggcauagcgccgccacagcuauuuauugccucaugggaucuggccagcugcuuugggacaccgugacaggggucgauauggcccuguga

SEQ ID NO: 212941 - RNA, 1401 nt, Artificial Sequence; identical to SEQ ID NO: 211919
  derived and/or modified sequence opt5 from neuraminidase__InfluenzaB__AGZ60025

SEQ ID NO: 212942 - RNA, 1401 nt, Artificial Sequence
  derived and/or modified sequence opt5 from neuraminidase__InfluenzaB__AGZ60037
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauuuuucccaccggacgcgugaagcacaccgaagaguguacaugcggcuucgccagcaacaaaacgaucgaaugugcuugcagagauaauuccuacaccgccaagcggccguuuguuaaacuuaacguggagacagacaccgccgaaauucgccugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugaguccgaugcgcuggccuuuucuggcgugauggucagcaugaaggaacccgggugguacuccuucggcuucgagaucaaagacaagaaaugcgauguuccuuguauuggaaucgaaauggugcacgacggcgggaaggagacauggcauagcgcugccaccgccauuuauugccucaugggaucuggccagcugcuuugggauacagugacgggggucgacaucgcucuguga

SEQ ID NO: 212943 - RNA, 1401 nt, Artificial Sequence; identical to SEQ ID NO: 212155
  derived and/or modified sequence opt5 from neuraminidase__InfluenzaB__AGZ60048

SEQ ID NO: 212944 - RNA, 1401 nt, Artificial Sequence; identical to SEQ ID NO: 212155
  derived and/or modified sequence opt5 from neuraminidase__InfluenzaB__AGZ60059

SEQ ID NO: 212945 - RNA, 1401 nt, Artificial Sequence
  derived and/or modified sequence opt5 from neuraminidase__InfluenzaB__AGZ60070
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgcucgauugcgccaacgcgucuaauguucaagcugugaaccacagcgccgccaaaggagugacacugcuucugcccgaaccugaguggaccuaucccagacucuccuguccuggcagcacguuccagaaggcucugcuuauuucuccccaucgguuuggggaaaccaaaggaaauuccgccccucugaucauucgcgagccguucaucgcuugcggccccaaggaauguaaacacuuugcccucacacauuacgcggcccagccugggggauauuacaacggcaccagagaggaccggaauaagcugcgccaccugaucagcgucaagcucggcaaaauucccacaguggagaacucuaucuuccauauggcugccugguccgggagcgcuugccacgauggaaaggaauggaccuauauuggcguugacgggccugauucuaaugcccugcuuaaaaucaaguacggagaggcguacacggacacauaucacuccuacgcccauaacauucugagaacccaggaaagcgcuuguaauugcaucggcgggaacuguuaucucaugauuacagauggauccgccucuggcaucagcgagugccgguuucugaaaauccgcgagggcagaauuaucaaggaaauuuuccccaccgggcgggugaagcacaccgaggaauguacaugcggauuugcuaauaacaaaacgaucgagugugccugccgcgacaauuccuacaccgccaagagaccguucgucaaacuuaacguggaaacagauaccgcugagauucggcugaugugcacagagaccuaucucgacacgccucgccccgaugacggcagcaucacagggccuugugaaucuaauggaaacaagggcuccgggggaaucaaaggcggcuuuguucaucaaagaauggcgagcaagauugggcggugguacucucgcaccaugagcaaaaccaagagaaugggaaugggccuguaugugaaguacgauggggaccccuggacagacuccgaugcccuggucuucucuggagugaugaucagcguggaggaacccggcugguacuccuuuggguucgagauuaaagacaagaaaugcgaugucccuuguaucggcauugaaaugguucacgacggaggcaaggagaccuggcacagcgcugccacagccaucuauugccucauggggucuggacagcugcuuugggauacggugaccggcgugaacaugacacuguga

SEQ ID NO: 212946 - RNA, 1401 nt, Artificial Sequence; identical to SEQ ID NO: 211651
  derived and/or modified sequence opt5 from neuraminidase__InfluenzaB__AGZ60081

SEQ ID NO: 212947 - RNA, 1401 nt, Artificial Sequence; identical to SEQ ID NO: 212171
  derived and/or modified sequence opt5 from neuraminidase__InfluenzaB__AGZ60092

SEQ ID NO: 212948 - RNA, 1401 nt, Artificial Sequence; identical to SEQ ID NO: 212794
  derived and/or modified sequence opt5 from neuraminidase__InfluenzaB__AGZ60103

SEQ ID NO: 212949 - RNA, 1401 nt, Artificial Sequence; identical to SEQ ID NO: 211812
  derived and/or modified sequence opt5 from neuraminidase__InfluenzaB__AGZ60135

SEQ ID NO: 212950 - RNA, 1401 nt, Artificial Sequence; identical to SEQ ID NO: 211984
  derived and/or modified sequence opt5 from neuraminidase__InfluenzaB__AGZ60154

SEQ ID NO: 212951 - RNA, 1401 nt, Artificial Sequence
  derived and/or modified sequence opt5 from neuraminidase__InfluenzaB__AGZ60164
augcugcccagcaccacacagacgcucacccuguuccuuacauccggcggggugcugcucucucuguacgucagcgccucccuuucuuaucugcucuacagcgacauccugcugaaguuuucccaaaccgagauuacagcuccuaucaugccgcucgauugcgccaacgcgucuaauguucaggcugugaacagaagcgccgccaaaggagugacccugcuucugcccgaaccugaguggacauauccccggcucuccuguccuggcagcaccuuccagaaggcucugcuuauuaauccccaccgcuuuggggaaacgaaaggaaacucugccccucugaucauuagagagccguucaucgcuugcggccccaccgaauguaagcauuuugcccucacacacuacgcggcccagccugggggauauuacaauggcacccgggaggaccgcaacaaacugagacaucugaucuccgucaagcucggcaagauucccacaguggagaauagcaucuuccacauggcugccuggucuggguccgcuugccaugauggaaaagaauggaccuauauuggcguugacgggccugauagcaacgcccugcuuaagaucaaauacggagaggcguacacggacacauaucacucuuacgccaagaauauucugcggacccaagaauccgcuuguaacugcaucggcggggauuguuaucucaugauuacagacggacccgccagcggcaucuccgagugccgcuuucugaaaaucagagagggccggauuaucaaggaaauuuucccgaccgggcgcgugaagcacaccgaggaauguacaugcggauuugcuucuaauaaaacgaucgagugugccugcagagauaacagcuacaccgccaagcggccuuucgucaaacuuaauguggaaacagacaccgcugagauucgccugaugugcacagagaccuaucucgauacgcccagaccuaacgacggcuccaucacagggcccugugaaagcgauggagacaagggcucugggggaaucaaaggcggcuuuguucaucagcggauggcguccaagauugggcgcugguacagcagaaccaugucuaaaaccaagcggaugggaaugggccuguaugugaaguacgacggggaucccuggacagacagcgaggcccuggcucucuccggagucauggugucuauggaggaaccuggcugguacagcuucggguuugaaaucaaagauaagaaaugcgacgugccguguauuggcaucgagaugguccacgauggaggcaagaccacauggcauuccgccgccacggcuauuuauugccugauggggagcggacagcuucugugggacaccguuacaggcguggauauggcccucuga

SEQ ID NO: 212952 - RNA, 1401 nt, Artificial Sequence; identical to SEQ ID NO: 212864
  derived and/or modified sequence opt5 from neuraminidase__InfluenzaB__AGZ60176

SEQ ID NO: 212953 - RNA, 1401 nt, Artificial Sequence; identical to SEQ ID NO: 211841
  derived and/or modified sequence opt5 from neuraminidase__InfluenzaB__AGZ60187

SEQ ID NO: 212954 - RNA, 1401 nt, Artificial Sequence; identical to SEQ ID NO: 211841
  derived and/or modified sequence opt5 from neuraminidase__InfluenzaB__AGZ60198

SEQ ID NO: 212955 - RNA, 1401 nt, Artificial Sequence; identical to SEQ ID NO: 211841
  derived and/or modified sequence opt5 from neuraminidase__InfluenzaB__AGZ60210

SEQ ID NO: 212956 - RNA, 1401 nt, Artificial Sequence
  derived and/or modified sequence opt5 from neuraminidase__InfluenzaB__AGZ60221
augcugcccaccacaauccagacgcucacccuguuccuuacaagcggcggggugcugcucucccuguacgucucugccagccuuuccuaucugcucuacucugacauucugcugaaguuuagcagaaccgagaucacagcuccuauuaugccgcucgauugcgccaacgcguccaauguucaagcugugaaccggucugccaccaaaggagugacacugcuucugcccgaaccugaguggaccuauccccgccucagcuguccuggcuccacguuccagaaggcccugcuuaucagcccccacagauuuggggaaaccaaaggaaauucugcuccucugauuauccgggagccguucaucgccugcggccccaaggaauguaaacauuuugcucucacacacuacgccgcgcagccugggggauauuacaacggcacccgcgaggacagaaauaagcugcggcaucugauuuccgucaagcucggcaaaauccccacaguggagaacagcauuuuccacauggccgcuuggucuggguccgccugccaugauggacgcgaauggaccuauaucggcguugacgggccugauagcaaugcucugcuuaagauuaaauacggagaggccuacacggacacauaucacucuuacgcgaagaacauccugagaacccaggaauccgccuguaauugcauuggcggggauuguuaucucaugaucacagacggacccgcuagcggcaucuccgagugccgguuucugaaaauucgcgagggcagaaucauuaaggaaaucuucccgaccgggcgggugaagcacaccgaggaauguacaugcggauuugccucuaacaaaacgauugagugugcuugccgcgauaauagcuacaccgccaagagaccuuucgucaaacuuaacguggaaacagacaccgccgagauccggcugaugugcacagagaccuaucucgauacgccccgcccuaaugacggcuccaucacagggcccugugaaagcaacggagauaagggcucugggggaauuaaaggcggcuuuguucaucaaagaauggcuuccaagaucgggcggugguacagcagaaccaugucuaaaaccaagcgcaugggaaugggccuguaugugaaguacgacggggaccccuggacagauagcgaggcgcuggcccucuccggagucauggugucuauggaggaaccuggcugguacagcuucggguuugaaauuaaagacaagaaaugcgaugugccguguaucggcauugagaugguccacgacggaggcaagaccacauggcauuccgcugccacggccaucuauugccugauggggagcggacagcuucugugggauaccguuacaggcgugaauaugacccucuga

SEQ ID NO: 212957 - RNA, 1401 nt, Artificial Sequence
  derived and/or modified sequence opt5 from neuraminidase__InfluenzaB__AGZ60272
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccaagccugaauggaccuauccccggcucuccuguccuggcagcacauuccagaaagcucugcuuaucucuccccaccgcuuuggggagaccaagggaaauuccgccccucugauuaucagagaaccguucaucgcuugcggccccacggaguguaaacauuuugcccucacccacuacgcggcccagccugggggauauuacaacggcacacgggaagaccgcaauaagcugagacaucugauuagcgucaagcucggcaaaauccccaccguggagaacucuauuuuccacauggcugccugguccgggagcgcuugccaugauggaaaggaguggacauauaucggcguugacgggccugauucuaaugcccugcuuaaaauuaaguacggagaagcguacaccgacacguaucacuccuacgccaaaaacauccugcggacacaagagagcgcuuguaauugcauuggcggggauuguuaucucaugaucaccgacggacccgccuccggcaucucugaaugccgcuuucugaagauuagagagggccggaucauuaaggagaucuucccgacagggcgcgugaaacacaccgaagaguguaccugcggauuugcuagcaacaagacaauugaaugugccugcagagauaauuccuacacggccaaacggccuuucgucaaacuuaacguggagaccgacacagcugaaauccgccugaugugcaccgagacauaucucgauacccccagaccuaaugacggcagcaucacggggcccugugagucugauggagacaagggcuccgggggaauuaagggcggcuuuguucaucagcggauggcgagcaaaaucgggcgcugguacucuagaacaaugagcaagaccaagcggaugggaaugggccuguaugugaaauacgacggggaucccuggaccgacuccgaagcccuggcucucucuggagucauggugagcauggaggaaccuggcugguacuccuucggguuugagauuaaggauaaaaagugcgacgugccguguaucggcauugaaaugguccacgauggaggcaaaacaaccuggcauagcgccgccacagcuaucuauugccugauggggucuggacagcuucugugggacacgguuaccggcguggauauggcccucuga

SEQ ID NO: 212958 - RNA, 1398 nt, Artificial Sequence
  derived and/or modified sequence opt5 from neuraminidase__InfluenzaB__AHL91182
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaugucccuggauugcgccaacgcgucuaauguucaagcugugaaccacagcgccaccaaggagaugaaauuccuucccccugaacccgaguggacauauccuagacuguccugucagggaagcaccuuucagaaggcccuccugaucucuccccaucgguucggcgaagcuaaaggaaauuccgccccucuuauuauccgcgagccguuuaucgcuugcgggcccaaggaauguaagcacuucgcccugacacauuacgcggcccagccuggcggguauuacaacggaaccagagaggaccggaauaaacuccgccaccugauuagcgugaaccugggcaagauccccacggucgaaaauucuauuuuucauauggcugccugguccggcagcgcuugccacgaugggagagaauggaccuauaucggaguggacggcccugauucuaacgcccucauuaaaaucaaguacggggaggcguacacagacaccuaucacuccuacgccaauaacauucugcggacacaagaaagcgcuuguaauugcaucggaggcgauuguuaucuuaugaucaccgacggguccgccucuggaauuagcaaaugccgcuuccugaagaucagagagggccggauuaucaaggagauuuuucccacgggccgcguugaacauacagaggaauguaccugcggguucgcuuccaacaaaacaaucgagugugccugcagagauaauagcuacaccgccaagcggccguuugugaaacucaacgucgaaaccgacacagcugagauccgccugaugugcacggagaccuaucuugauacaccuagacccgacgauggaucuauuaccggcccuugugaauccaauggggacaagggacggggcggggugaaaggaggcuucguucaccagcgcauggcgagcaagaucggcagaugguacucucggacaaugagcaaaaccaagagaauggggauggagcuguaugugaaguacgacggagaucccuggacggacuccgaugcccucgcucccucuggcgucauggugagcauggaggagccugggugguacuccuuuggauucgaaauuaaagacaagaaaugcgaugugccguguaucggcauugagaugguccaugacgggggcaagcgcacauggcacagcgccgccaccgcuaucuauugccugaugggaucuggccagcugcucugggauaccguuacagggguggacauggcccuguga

SEQ ID NO: 212959 - RNA, 1398 nt, Artificial Sequence
  derived and/or modified sequence opt5 from neuraminidase__InfluenzaB__AHL91193
augcugcccagcaccauccagacacucacgcuguuccuuaccuccggcggggugcugcucucucuguacgucagcgcccuucuguccuaucuccuguacucugacauucugcucaaguuuagcccuaaaaucauugcuccgacaaugucccuggauugcgccaacgcgucuaauguucaagcugugaaccacagcgccaccaaggagaugaaauuccuucccuccgaaccugaguggacauaucccagacugagcugucagggaucuaccuuucagaaggcccuccugaucuccccucaucgguucggcgaagcuaaagggaauagcgcuccccuuauuauccgcgagccuuuuaucgccugcggaccgaaggaauguaagcacuucgcccugacacauuacgcggcccagcccggcggguauuacaacggaaccagagaggaccggaauaaacuccgccaccugauuucugugaaccugggcaagaucccuacggucgaaaauuccauuuuucauauggcugccuggagcggcucugcuugccacgaugggagagaauggaccuauaucggaguggacggccccgauuccaacgcccucauuaaaaucaaguacggggaggcguacacagacaccuaucacagcuacgccaauaacauucugcggacacaagaauccgcuuguaauugcaucggaggcgauuguuaucuuaugaucaccgacgggucugccagcggaauuuccaaaugccgcuuccugaagaucagagagggccggauuaucaaggagauuuuuccuacgggccgcguugaacauacagaggaauguaccugcggguucgcuagcaacaaaacaaucgagugugccugcagagauaauucuuacaccgccaagcggcccuuugugaaacucaacgucgaaaccgacacagcugagauccgccugaugugcacggagaccuaucuugauacaccgagaccugacgauggauccauuaccggccccugugaaagcaauggggacaagggacggggcggggugaaaggaggcuucguucaccagcgcauggcgucuaagaucggcagaugguacagccggacaauguccaaaaccaagagaauggggauggagcuguaugugaaguacgacggagauccuuggacggacucugaugcccucgcucccagcggcgucaugguguccauggaggagcccgggugguacagcuuuggauucgaaauuaaagacaagaaaugcgaugugccuuguaucggcauugagaugguccaugacgggggcaagcgcacauggcacucugccgccaccgcuaucuauugccugaugggauccggccagcugcucugggauaccguuacagggguggacauggcccuguga

SEQ ID NO: 212960 - RNA, 1398 nt, Artificial Sequence
  derived and/or modified sequence opt5 from neuraminidase__InfluenzaB__AHL91204
augcugcccagcaccauccagacacucacgcuguuccuuaccuccggcggggugcugcucucucuguacgucagcgcccuucuguccuaucuccuguacucugacguucugcucaaguuuagcccuaaaauuaucgcuccgacaaugucccuggauugcgccaacgcgucuaaugugcaagcugugaaccacagcgccaccgaggaaaugacauuccuucugcccgagccugaauggaccuaucccagacucuccugucagggaagcacauuucagaaggcccugcuuauuucuccucaucgguucggcgaggcuaaaggaaauuccgcuccccugaucauucgcgaaccuuuuaucgccugcgggccgaaggaguguaaacacuucgcccucacccauuacgcggcccagcccggcggguauuacaacggaacgagagaggaccggaauaagcugcgccaccugaucagcgucaaccucggcaagauuccuaccguggaaaauucuaucuuucauauggcugccugguccggcagcgcuugccacgaugggagagaguggacauauauuggaguugacggccccgauucuaacgcccugaucaaaauuaaguacggggaagcguacaccgacacauaucacuccuacgccaauaacauccuucggacccaagagagcgcuuguaauugcauuggaggcgauuguuaucugaugaucacggacggguccgccucuggaaucagcaaaugccgcuuccucaagauuagagagggccggaucauuaaagaaaucuuuccuacaggccgcguggagcauaccgaagaguguacaugcggguucgcuuccaacaagaccauugaaugugccugcagagauaauaucuacaccgccaagcggcccuuugucaaacugaacguggagacagacacggcugagauccgccuuaugugcaccgaaacauaucuggauaccccgagaccugacgauggaagcauuacaggccccugugagucuaauggggacaagggacacggcgggaucaaaggaggcuucguucaucagcggauggcguccaagauuggccgcugguacagcagaaccaugucuaaaacgaagcggauggggauggaacucuaugugaaauacgacggagauccuuggacagacagcgaugcccuggcucccuccggcgucauggugucuauggaggaacccgggugguacagcuuuggauucgagaucaaggacaagaaaugcgaugugccuuguauuggcaucgagaugguccacgacgggggcaagaaaaccuggcacuccgccgccaccgcuaucuauugccugaugggaagcggccagcuccugugggauacaguuaccgggguggacauggcccuuuga

SEQ ID NO: 212961 - RNA, 1398 nt, Artificial Sequence
  derived and/or modified sequence opt5 from neuraminidase__InfluenzaB__AHL91215
augcugcccagcaccauccagacacucacgcuguuccuuaccuccggcggggugcugcucucucuguacgucagcacacuucuguccuaucuccuguacucugacauucugcucaaguuuagcccuaaaaucauugccccgaccacaucccuggauugcgcuaacgccucuaauguucaagcggugaaccacagcgcuaccaaggagaugaaauuccuucccacagaaccugaguggaccuaucccagacuguccugucagggaagcacguuucagaaggcccuccugaucucuccucaucgguucggcgaagccaaaggaaauuccgcuccccuuauuauccgcgagccuuuuaucgccugcgggccgaaggaauguaagcacuucgcucugacccauuacgccgcgcagcccggcggguauuacaacggaacaagagaggaccggaauaaacuccgccaccugauuagcgugaaccugggcaagaucccuaccgucgaaaauucuauuuuucauauggccgcuugguccggcagcgccugccacgaugggagagaauggacauauaucggaguggacggccccgauucuaacgcucucauuaaaaucaaguacggggaggccuacaccgacacguaucacuccuacgcgaauaacauucugcggacacaagaaagcgccuguaauugcaucggaggcgauuguuaucuuaugaucaccgacggguccgcuucuggaauuagcaaaugccgcuuccugaagaucagagagggccggauuaucaaggagauuuuuccuacaggccgcguugaacauaccgaggaauguaccugcggguucgccuccaacaaaacaaucgagugugcuugcagagauaauagcuacacggccaagcggcccuuugugaaacucaacgucgaaaccgacacagccgagauccgccugaugugcaccgagacauaucuugauaccccgagaccugacgauggaucuauuacgggccccugugaauccaauggggacaagggaagcggcggggugaaaggaggcuucguucaccagcggaugacaucuaagaucggccgcugguacagcagaaccauguccaaaaccaagcggauggggauggagcuguaugugaaguacgacggagauccuuggacagacucugaugcucucgcgcccagcggcgucaugguguccauggaggagcccgggugguacagcuuuggauucgaaauuaaagacaagaaaugcgaugugccuuguaucggcauugagaugguccaugacgggggcaagagaaccuggcacucugccgcuacagccaucuauugccugaugggauccggccagcugcucugggauacgguuaccgggguggacauggcccuguga

SEQ ID NO: 212962 - RNA, 1401 nt, Artificial Sequence; identical to SEQ ID NO: 211733
  derived and/or modified sequence opt5 from neuraminidase__InfluenzaB__AHL91226

SEQ ID NO: 212963 - RNA, 1401 nt, Artificial Sequence; identical to SEQ ID NO: 211734
  derived and/or modified sequence opt5 from neuraminidase__InfluenzaB__AHL91237

SEQ ID NO: 212964 - RNA, 1401 nt, Artificial Sequence; identical to SEQ ID NO: 211734
  derived and/or modified sequence opt5 from neuraminidase__InfluenzaB__AHL91248

SEQ ID NO: 212965 - RNA, 1401 nt, Artificial Sequence; identical to SEQ ID NO: 211733
  derived and/or modified sequence opt5 from neuraminidase__InfluenzaB__AHL91259

SEQ ID NO: 212966 - RNA, 1401 nt, Artificial Sequence; identical to SEQ ID NO: 211733
  derived and/or modified sequence opt5 from neuraminidase__InfluenzaB__AHL91270

SEQ ID NO: 212967 - RNA, 1398 nt, Artificial Sequence; identical to SEQ ID NO: 211705
  derived and/or modified sequence opt5 from neuraminidase__InfluenzaB__AHL91281

SEQ ID NO: 212968 - RNA, 1401 nt, Artificial Sequence
  derived and/or modified sequence opt5 from neuraminidase__InfluenzaB__AHL91303
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggacgggaauggaccuauauuggcguugacgggcccgauucuaaugcucugcuuaagaucaaauacggagaggccuacacggacacauaucacuccuacgcgaacaauauucugcgcacccaggaaagcgccuguaacugcaucggcggggauuguuaucucaugauuacagacggauccgcuucuggcaucaaugagugcagauuucugaagauccgggagggccgcauuaucaaagaaauuuucccgaccgggagaguggagcacaccgaagaguguacaugcggauuugccagcaacaagacgaucgaaugugcuugccgggauaauuccuacaccgccaagcgcccuuucgucaaacuuaacguggagacagacaccgccgagauuagacugaugugcacagaaaccuaucucgauacgccccggccugacgauggcagcaucacagggcccugugagucuaauggagacaagggcuccgggggaaucaaaggcggcuuuguucaucaacgcauggcuagcaagauugggagaugguacucucggaccaugagcaaaaccagacgcaugggaaugggccuguaugugaaguacgacggggaucccuggacagacuccgaugcgcuggcccucucuggagucauggugagcauggaggaaccuggcugguacuccuucggguuugaaaucaaagacaagaagugcgaugugccguguauuggcaucgagaugguccacgacggaggcaaaaagaccuggcauagcgcugccacagccauuuauugccugauggggucuggacagcuucugugggauacgguuaccggcguggacauggcucucuga

SEQ ID NO: 212969 - RNA, 1401 nt, Artificial Sequence; identical to SEQ ID NO: 211734
  derived and/or modified sequence opt5 from neuraminidase__InfluenzaB__AHL91314

SEQ ID NO: 212970 - RNA, 1401 nt, Artificial Sequence; identical to SEQ ID NO: 211734
  derived and/or modified sequence opt5 from neuraminidase__InfluenzaB__AHL91325

SEQ ID NO: 212971 - RNA, 1401 nt, Artificial Sequence
  derived and/or modified sequence opt5 from neuraminidase__InfluenzaB__AHL91347
augcugcccagcaccauccagacacucacgcuguuccuuaccuccggcggggugcugcucucucuguacgucagcgccucccuuucuuaucugcucuacagcgacguucugcugaaguuuuccccuacagagauuaccgcuccgacaaugccccucgauugcgccaacgcgucuaaugugcaagcugugaacagaagcgccaccaaaggagucacacugcuucugccugaacccgaguggaccuauccucggcucuccugucccggcagcacguuccagaaggcccugcuuaucucuccucaccgcuuuggggaaaccaaaggaaauuccgcuccgcugauuaucagagagcccuucauugccugcggcccuaaggaauguaaacauuuugcucucacacacuacgccgcgcagcccgggggauauuacaacggcacccgggaggaccgcaauaagcugagacaucugaucagcgugaagcucggcaaaaucccuacaguugagaacucuauuuuccacauggccgcuugguccgggagcgccugccaugauggacgggaauggaccuauaucggcguggacgggcccgauucuaaugcucugcuuaagauuaaauacggagaggccuacacggacacauaucacuccuacgcgaacaauauccugcgcacccaggaaagcgccuguaacugcauuggcggggauuguuaucucaugaucacagacggauccgcuucuggcauuagcgagugcagauuucugaagauccgggagggccgcaucgucaaagaaauuuucccgaccgggagaguggagcacaccgaagaguguacaugcggauuugccuccaauaagacgaucgaaugugcuugccgggauaacagcuacaccgccaagcgcccuuucguuaaacuuaauguggagacagacaccgccgagauuagacugaugugcacagaaaccuaucucgauacgccccggccugaggacggcucuaucacagggcccugugaauccaacggagauaagggcagcgggggaauuaaaggcggcuuuguccaucaacgcauggcuucuaagaucgggagaugguacagccggaccauguccaaaaccaagagaaugggaaugggccuguaugugaaauacgacggggaccccuggacagauucugacgcgcuggcccucagcggagugauggucuccauggaggaaccuggcugguacagcuucggguuugagaucaaggauaagaaaugcgacguuccguguauuggcaucgagauggugcacgauggaggcaaggaaaccuggcauucugcugccacagccauuuauugccugaugggguccggacagcuucugugggacacggugaccggcgucgauauggcucucuga

SEQ ID NO: 212972 - RNA, 1401 nt, Artificial Sequence; identical to SEQ ID NO: 212971
  derived and/or modified sequence opt5 from neuraminidase__InfluenzaB__AHL91358

SEQ ID NO: 212973 - RNA, 1401 nt, Artificial Sequence; identical to SEQ ID NO: 211709
  derived and/or modified sequence opt5 from neuraminidase__InfluenzaB__AHL91369

SEQ ID NO: 212974 - RNA, 1401 nt, Artificial Sequence; identical to SEQ ID NO: 211709
  derived and/or modified sequence opt5 from neuraminidase__InfluenzaB__AHL91380

SEQ ID NO: 212975 - RNA, 1401 nt, Artificial Sequence
  derived and/or modified sequence opt5 from neuraminidase__InfluenzaB__AHL91391
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucaacugcgccaaugcgucuaacguucaagcugugaauagaagcgccacaaagggagugacccugccucuucccgaaccugaguggacauauccccggcuguccuguccuggcagcaccuuccagaaagcccuccugauuucuccgcaccgcuuuggggaaacgaagggaaacuccgcuccccuuaucauuagagagccuuucaucgccugcggccccaaagaauguaagcauuuugcucugacccacuacgccgcgcagccugggggauauuacaauggcacacgggaggaucgcaacaagcucagacaucugaucagcgucaaacugggcaagauucccaccguggaaaauucuaucuuccacauggccgcuugguccgggagcgccugccaugacggacgggaauggacauauauuggcguugaugggccggacaacaaugcucuccugaaaaucaaguacggagaggccuacaccgauacguaucacucuuacgcgaacaauauucuucgcacacaggaauccgccuguaacugcaucggcggggacuguuaucugaugauuaccgauggaagcgcuuccggcaucucugagugcagauuucucaaaauccgggagggccgcauuaucaaggaaauuuucccuacagggagaguggagcacaccgaagaguguaccugcggauuugccagcaauaagacaaucgaaugugcuugccgggacaacuccuacacggccaaacgccccuucgucaagcugaauguggagaccgauacagccgagauuagacuuaugugcaccgaaacauaucuggacaccccucggcccgaugacggcagcaucacggggcccugugagucuaacggagauaaaggcuccgggggaaucaagggcggcuuuguucaucaacgcauggcuagcaaaauugggagaugguacucucggacaaugagcaagaccaaaagaaugggaaugggccucuaugugaaguacgacggggacccuuggaucgauuccgacgcgcugacccugucuggagucauggugagcauggaggagccgggcugguacuccuucggguuugaaauuaaggauaaaaagugcgacgugcccuguaucggcauugagaugguccacgauggaggcaaaacaaccuggcauagcgccgcuacagccaucuauugccucauggggucuggacagcugcuuugggacacgguuaccggcguggauauggcccuguga

SEQ ID NO: 212976 - RNA, 1401 nt, Artificial Sequence
  derived and/or modified sequence opt5 from neuraminidase__InfluenzaB__AHL91413
augcugcccagcaccauccagacacucacgcuguuccuuaccuccggcggggugcugcucucucuguacgucagcgccucccuuucuuaucugcucuacagcgacauucugcugaaguuuacaccuaccgagaucacagcuccgaccaugccccucgauugcgccaacgcguccaauguucaagcugugaaccugucugccacaaaaggagugacccuucugcucccugaacccgaguggacguauccuagacugagcugucccggcuccaccuuccagaaggcccuucugauuagcccucaccgguuuggggaaacaaaaggaaauucugcuccgcucaucauucgcgagcccuucaucgccugcggcccuaaggaauguaaacauuuugcucugacccacuacgccgcgcagcccgggggauauuacaacggcacaagagaggaccggaauaagcugcgccaucucaucuccgucaagcugggcaaaauuccuaccguggagaacagcaucuuccacauggccgcuuggucuggguccgccugccaugauggaaaggaauggacguauauuggcguugacgggcccgauagcaaugcccuucugaaaaucaaguacggagaggcuuacacagacaccuaucacucuuacgcgaacaauauucucagaacacaggaauccgccuguaacugcaucggcgggaauuguuaucugaugauuaccgauggaagcgcuuccggcaucucugagugccgguuucuuaaaauccgcgagggcagaauuaucaaggaaauuuucccgaccgggcgggugaagcacacagaggaauguacgugcggauuugccagcaacaaaaccaucgagugugcuugccgcgacaauuccuacacagccaagagaccuuucgucaaacugaacguggaaaccgauacagccgagauucggcucaugugcaccgagacguaucuggacacaccccgcccugaugacggcagcaucaccgggcccugugaaucuaauggaaacaagggcuccgggggaaucaaaggcggcuuuguucaucaaagaauggcuagcaagauugggcggugguacucucgcaccaugagcaaaacaaagagaaugggaaugggccuguaugugaaguacgauggggaccccuggaccgacuccgaugcgcucgcccugucuggagucauggugagcauggaggaaccuggcugguacuccuucggguuugagaucaaagacaagaaaugcgaugugccguguauuggcaucgaaaugguccacgacggaggcaaggagacauggcauagcgcugccacggccauuuauugccuuauggggucuggacagcugcucugggauaccguuacaggcguggacauggcucuguga

SEQ ID NO: 212977 - RNA, 1401 nt, Artificial Sequence
  derived and/or modified sequence opt5 from neuraminidase__InfluenzaB__AHL91446
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggaaugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgugaagcucggcaaaauuccuacagucgagaacucuaucuuccacauggccgcuugguccgggagcgccugccaugauggaaaggaauggaccuauauuggcguggacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcguugagcacaccgaagaguguacaugcggauuugccuccaacaagacgaucgaaugugcuugcagagacaauagcuacaccgccaaacggccuuucgugaaacuuaacgucgagacagauaccgccgagauucgccugaugugcacagaaaccuaucucgacacgcccagaccugaugacggcucuaucacagggcccugugaguccaauggaggcaaggggagcggaggcaucaagggcggguuugugcaucaacggauggaaucuaaaauuggacgcugguacagcagaaccauguccaagaccaaacggaugggcauggggcuguauguuaaguacgauggagaccccuggacagacucugaugcucuggcgcucagcggcgugauggucuccauggaggaaccugggugguacagcuucggcuuugagaucaaggacaaagagugcgaugugccguguauuggaaucgaaauggugcacgacggcgggaaggagaccuggcauucugccgcuacagccauuuauugccugaugggauccggccagcuucugugggauacggucaccgggguuaacauggcccucuga

SEQ ID NO: 212978 - RNA, 1401 nt, Artificial Sequence
  derived and/or modified sequence opt5 from neuraminidase__InfluenzaB__AHL91457
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgauuaugccccucgauugcgccaacgcgucuaauguucaagcugugaacagaagcgccacaaaaggagugacccugcuucugccugaacccgaguggacauauccucggcucuccugucccggcagcaccuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauaauaacgcucugcuuaaaauuaaguacggcgaagccuacaccgacacguaucacucuuacgcgaauaacacacugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcaacaagggguccggaggcaucaaaggcggguuuguucaucaacggauggcuagcaagauuggacgcugguacucuagaaccaugagcaaaaccaagcggaugggcauggggcuguaugugaaguacgauggagaccccuggacagacuccgaugcgcuggcccucucuggcgucauggugagcauggaggaaccugggugguacuccuucggcuuugaaaucaaagacaagaaaugcgaugugccguguauuggaaucgagaugguccacgacggcgggaaggaaaccuggcauagcgcugccacagccauuuauugccugaugggaucuggccagcuucugugggauacgguuaccgggguggacauggcucucuga

SEQ ID NO: 212979 - RNA, 1401 nt, Artificial Sequence
  derived and/or modified sequence opt5 from neuraminidase__InfluenzaB__AHL91468
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcgugaagcacaccgaggaauguacaugcggauuugccuccaacaaaacgaucgagugugcuugcagagacaauagcuacaccgccaagcggccuuucgucaaacuuaacguggaaacagauaccgccgagauucgccugaugugcacagagaccuaucucgacacgcccagaccugaugacggcucuaucacagggcccugugaauccaauggagauaagggcagcgggggaaucaaaggcggcuuuguucaucaacggauggcuucuaagauugggcgcugguacagcagaaccauguccaaaaccaagcggaugggaaugggccuguaugugaaguacgacggggaccccuggacagauucugacgcgcuggcccucagcggagucaugguguccgugggcgagccugggugguacagcuucggcuuugaaaucaaagauaagaaaugcgacgucccguguauuggaaucgagaugguucacgauggcgggaaggaaaccuggcauucugcugccacagccauuuauugccugaugggauccggccagcuucugugggacacggugaccgggguggauauggcucucuga

SEQ ID NO: 212980 - RNA, 1401 nt, Artificial Sequence
  derived and/or modified sequence opt5 from neuraminidase__InfluenzaB__AHL91479
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugcccucugauugcgccaacgcgagcaauguucaagcugugaacagauccgccaccaaaggagugacacuccugcuuccugaacccgaguggaccuauccucggcugagcugucccggcucuacguuccagaaggcccuccugauuuccccucaccgcuuuggggaaaccaaaggaaauagcgcuccgcuuaucauuagagagcccuucaucgccugcggcccuaaggaauguaaacauuuugcucugacacacuacgccgcgcagcccgggggauauuacaacggcacccggggcgaccgcaauaagcucagacaucugaucucugucaagcuggggaaaauuccuacaguggagaacuccaucuuccacauggccgcuuggagcggaucugccugccaugauggcaaggaguggaccuauauugggguugacggacccgauuccaaugcucuccugaaaaucaaguacggcgaagccuacacggacacauaucacagcuacgcgaacaauauucuucggacccaggaguccgccuguaacugcaucgggggaaauuguuaucugaugauuacagauggcucugcuagcggcaucuccgaaugccgcuuucucaaaaucagagaggggcggauuaucaaggagauuuucccgaccggacgcgugaagcacaccgaagaguguacaugcggcuuugccagcaacaaaacgaucgaaugugcuugcagagacaauucuuacaccgccaagcggccuuucgucaaacugaacguggagacagauaccgccgaaauucgccuuaugugcacagagaccuaucuggacacgcccagaccugaugacggguccaucacaggacccugugagagcaauggcgauaaggggucuggaggcaucaaaggcggguuuguucaucaacggauggcuagcaagauuggacgcugguacuccagaaccaugucuaaaaccaagcggaugggcauggggcucuaugugaaguacgacggagaccccuggacagauagcgacgcgcuggcccuguccggcgucauggugagcauggaggaaccugggugguacucuuucggcuuugaaaucaaagauaagaaaugcgacgugccguguauuggaaucgagaugguccacgauggcgggaaggaaaccuggcauuccgcugccacagccauuuauugccucaugggaagcggccagcugcuuugggacacgguuaccgggguggauauggcucuguga

SEQ ID NO: 212981 - RNA, 1401 nt, Artificial Sequence
  derived and/or modified sequence opt5 from neuraminidase__InfluenzaB__AHL91501
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggaaugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccgggaggaccgcaauaagcugagacaucugaucagcgugaagcucggcaaaauuccuacagucgagaacucuaucuuccacauggccgcuugguccgggagcgccugccaugauggaaaggaauggaccuauauuggcguggacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcguugagcacaccgaagaguguacaugcggauuugccuccaacaagacgaucgaaugugcuugcagagacaauagcuacaccgccaaacggccuuucgugaaacuuaacgucgagacagauaccgccgagauucgccugaugugcacagaaaccuaucucgacacgcccagaccugaugacggcucuaucacagggcccugugaguccaauggaggcaaggggagcggaggcaucaagggcggguuugugcaucaacggauggaaucuaaaauuggacgcugguacagcagaaccauguccaagaccaaacggaugggcauggggcuguauguuaaguacgauggagaccccuggacagacucugaugcucuggcgcucagcggcgugauggucuccauggaggaaccugggugguacagcuucggcuuugagaucaaggacaaaaagugcgaugugccguguauuggaaucgagauggugcacgacggcgggaaagaaaccuggcauucugccgcuacagccauuuauugccugaugggauccggccagcuucugugggauacggucaccgggguuaacauggcccucuga

SEQ ID NO: 212982 - RNA, 1401 nt, Artificial Sequence
  derived and/or modified sequence opt5 from neuraminidase__InfluenzaB__AHL91512
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcauuuuccagaaggcccugcuuaucucuccucaccgcuuuggggaaacgaaaggaaauuccgcuccgcugauuaucagagagcccuucaucgccugcggcccuaaggaauguaaacauuuugcucucacccacuacgccgcgcagcccgggggauauuacaacggcacacggggcgaccgcaauaagcugagacaucugauuagcgucaagcucgggaaaaucccuaccguggagaacucuauuuuccacauggccgcuugguccggaagcgccugccaugauggcaaggaguggacauauaucgggguugacggacccgauucuaaugcucugcuuaaaauuaaguacggcgaagccuacaccgacacguaucacuccuacgcgaacaauauccugcggacacaggagagcgccuguaacugcauugggggaaauuguuaucucaugaucaccgauggcuccgcuucuggcaucagcgaaugccgcuuucugaaaauuagagaggggcggaucauuaaggagaucuucccgacaggacgcgugaagcacaccgaagaguguaccugcggcuuugccuccaacaaaacaauugaaugugcuugcagagacaauagcuacacggccaagcggccuuucgucaaacuuaacguggagaccgauacagccgaaauccgccugaugugcaccgagacauaucucgacacccccagaccugaugacgggucuaucacgggacccugugaguccaauggcgauaaggggagcggaggcauuaaaggcggguuuguucaucaacggauggcuucuaagaucggacgcugguacagcagaacaauguccaaaaccaagcggaugggcauggggcuguaugugaaguacgacggagaccccuggaccgauucugacgcgcuggcccucagcggcgucaugguguccauggaggaaccugggugguacagcuucggcuuugaaauuaaagauaagaaaugcgacgugccguguaucggaauugagaugguccacgauggcgggaaggaaacauggcauucugcugccaccgccaucuauugccugaugggauccggccagcuucugugggacacaguuacggggguggauauggcucucuga

SEQ ID NO: 212983 - RNA, 1401 nt, Artificial Sequence
  derived and/or modified sequence opt5 from neuraminidase__InfluenzaB__AHL91523
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcaucucugaaugccgcuuucugaaaaucagagaggggcggauuaucaaggagauuuucccgaccggacgcgugaagcacaccgaagaguguacaugcggcuuugccagcaauaaaacgaucgaaugugcuugcagagacaacuccuacaccgccaagcggccuuucgucaaacuuaauguggagacagauaccgccgaaauucgccugaugugcacagagaccuaucucgacacgcccagaccugaugacgggagcaucacaggacccugugagucuaacggcgauaagggguccggaggcaucaaaggcggguuuguucaucaacggauggcuagcaagauuggacgcugguacucuagaaccaugagcaaaaccaagcggaugggcauggggcuguaugugaaguacgacggagaccccuggacagauuccgacgcgcuggcccucucuggcgucauggugagcauggaggaaccugggugguacuccuucggcuuugaaaucaaagauaagaaaugcgacgugccguguauuggaaucgagaugguccacgauggcgggaaggaaaccuggcauagcgcugccacagccauuuauugccugaugggaucuggccagcuucugugggacacgguuaccgggguggauauggcucucuga

SEQ ID NO: 212984 - RNA, 1401 nt, Artificial Sequence; identical to SEQ ID NO: 212981
  derived and/or modified sequence opt5 from neuraminidase__InfluenzaB__AHL91534

SEQ ID NO: 212985 - RNA, 1401 nt, Artificial Sequence
  derived and/or modified sequence opt5 from neuraminidase__InfluenzaB__AHL91545
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucugcggacccaggagagcgccuguaacugcaucgggggaaauuguuaucucaugauuacagauggcuccgcuucuggcaucagcgaaugccgcuuucugaaaaucagagaggggcggauuaucaaggagauuuucccgaccggacgcgugaagcacaccgaagaguguacaugcggcuuugccuccaacaaaacgaucgaaugugcuugcagagacaauagcuacaccgccaagcggccuuucgucaaacuuaacguggagacagauaccgccgaaauucgccugaugugcacagagaccuaucucgacacgcccagaccugaugacgggucuaucacaggacccugugaguccaauggcgauaaggggagcggaggcaucaaaggcggguuuguucaucaacggaugaccucuaagauuggacgcugguacagcagaaccauguccaaaacaaagcggaugggcauggggcuguaugugaaguacgacggagaccccuggaccgauucugacgcucuggcgcucagcggcgucaugguguccauggaggaaccugggugguacagcuucggcuuugaaaucaaagauaagaaaugcgacgugccguguauuggaaucgagaugguccacgauggcgggaagggaacauggcauucugccgcuacggccauuuauugccugaugggcuccgggcagcuucugugggacaccguuacaggaguggauauggcccucuga

SEQ ID NO: 212986 - RNA, 1401 nt, Artificial Sequence; identical to SEQ ID NO: 212981
  derived and/or modified sequence opt5 from neuraminidase__InfluenzaB__AHL91556

SEQ ID NO: 212987 - RNA, 1401 nt, Artificial Sequence; identical to SEQ ID NO: 212981
  derived and/or modified sequence opt5 from neuraminidase__InfluenzaB__AHL91578

SEQ ID NO: 212988 - RNA, 1401 nt, Artificial Sequence; identical to SEQ ID NO: 211909
  derived and/or modified sequence opt5 from neuraminidase__InfluenzaB__AHL91589

SEQ ID NO: 212989 - RNA, 1401 nt, Artificial Sequence
  derived and/or modified sequence opt5 from neuraminidase__InfluenzaB__AHL91600
augcugcccagcaccauccagacacucacgcuguuccuuaccacaggcggggugcugcucucccuguacgucucugccagccuuuccuaucugcucuacucugacauucugcugaaguuuagcccuaccgagaucacagcuccgaccaugccccucgauugcgccaacgcguccaauguucaagcugugaacagaucugccacaaaaggagugaccuuccugcuuccugaacccgaguggacguauccucggcugagcugucccggcuccaccuuucagaaggcccuccugauuagcccucaccgcuucggggaaacaaaaggaaauucugcuccgcuuaucauuagagagcccuuuaucgccugcggcccuaaggaauguaaacauuucgcucugacccacuacgccgcgcagcccgggggauauuacaacggcacacggggcgaccgcaauaagcucagacaucugaucuccgucaagcuggggaaaauuccuaccguggagaacagcaucuuucacauggccgcuuggucuggauccgccugccaugauggcaaggaguggacguauauugggguugacggacccgauagcaaugcucuccugaaaaucaaguacggcgaagccuacacagacaccuaucacucuuacgcgaacaauauucuucggacacaggaguccgccuguaacugcaucgggggaaauuguuaucugaugauuaccgauggcagcgcuuccggcaucucugaaugccgcuuccucaaaaucagagaggggcggauuaucaaggagauuuuuccgaccggacgcgugaagcacacagaagaguguacgugcggcuucgccagcaacaaaaccaucgaaugugcuugcagagacaauuccuacacagccaagcggccuuuugucaaacugaacguggagaccgauacagccgaaauucgccuuaugugcaccgagacguaucuggacacacccagaccugaugacgggagcaucaccggacccugugagucuaauggcgauaagggguccggaggcaucaaaggcggguucguucaucaacggauggcuagcaagauuggacgcugguacucuagaaccaugagcaaaacaaagcggaugggcauggggcucuaugugaaguacgacggagaccccuggaccgauuccgacgcgcuggcccugucuggcgucauggugagcauggaggaaccugggugguacuccuuuggcuucgaaaucaaagauaagaaaugcgacgugccguguauuggaaucgagaugguccacgauggcgggaaggaaacauggcauagcgcugccacggccauuuauugccucaugggaucuggccagcugcuuugggacaccguuacagggguggauauggcucuguga

SEQ ID NO: 212990 - RNA, 1401 nt, Artificial Sequence; identical to SEQ ID NO: 212989
  derived and/or modified sequence opt5 from neuraminidase__InfluenzaB__AHL91611

SEQ ID NO: 212991 - RNA, 1401 nt, Artificial Sequence; identical to SEQ ID NO: 212981
  derived and/or modified sequence opt5 from neuraminidase__InfluenzaB__AHL91622

SEQ ID NO: 212992 - RNA, 1401 nt, Artificial Sequence; identical to SEQ ID NO: 212982
  derived and/or modified sequence opt5 from neuraminidase__InfluenzaB__AHL91633

SEQ ID NO: 212993 - RNA, 1401 nt, Artificial Sequence; identical to SEQ ID NO: 212982
  derived and/or modified sequence opt5 from neuraminidase__InfluenzaB__AHL91644

SEQ ID NO: 212994 - RNA, 1401 nt, Artificial Sequence
  derived and/or modified sequence opt5 from neuraminidase__InfluenzaB__AHL91655
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaagaagugacacugcuucugccugagcccgaauggaccuauccucggcucuccugucccggaagcacguuccagaaggcccugcuuauuucuccucaccgcuuuggcgagaccaaaggaaauuccgcuccgcugaucauuagagaacccuucaucgccugcgggccuaaggaguguaaacauuuugcucucacacacuacgccgcgcagcccggcggguauuacaacggaacccggggcgaccgcaauaagcugagacaucugaucagcgucaagcucggcaaaauuccuacaguggagaacucuaucuuccacauggccgcuugguccgggagcgccugccaugauggaaaggaauggaccuauauuggcguugacgggcccgauucuaaugcucugcuuaaaaucaaguacggagaggccuacacggacacauaucacuccuacgcgaacaauauucugcggacccaggaaagcgccuguaacugcaucggcgggaauuguuaucucaugauuacagauggauccgcuucuggcaucagcgagugccgcuuucugaaaaucagagagggccggauuaucaaggaaauuuucccgaccgggcgcgugaagcacaccgaggaauguacaugcggauuugccuccaacaaaacgaucgagugugcuugcagagacaauagcuacaccgccaagcggccuuucgucaaacuuaacguggaaacagauaccgccgagauucgccugaugugcacagagaccuaucucgacacgcccagaccugaugacggcucuaucacagggcccugugaauccaauggagauaagggcagcgggggaaucaaaggcggcuuuguucaucaacggauggcuucuaagauugggcgcugguacagcagaaccauguccaaaaccaagcggaugggaaugggccuguaugugaaguacgacggggaccccuggacagauucugacgcgcuggcccucagcggagucaugguguccauggaggaaccuggcugguacagcuucggguuugagaucaaagauaagaaaugcgacgugccguguauuggcaucgaaaugguccacgauggaggcaaggagaccuggcauucugcugccacagccauuuauugccugaugggguccggacagcuucugugggacacgguuaccggcguggauauggcucucuga

SEQ ID NO: 212995 - RNA, 1401 nt, Artificial Sequence; identical to SEQ ID NO: 212981
  derived and/or modified sequence opt5 from neuraminidase__InfluenzaB__AHL91666

SEQ ID NO: 212996 - RNA, 1401 nt, Artificial Sequence; identical to SEQ ID NO: 212982
  derived and/or modified sequence opt5 from neuraminidase__InfluenzaB__AHL91677

SEQ ID NO: 212997 - RNA, 1401 nt, Artificial Sequence; identical to SEQ ID NO: 212983
  derived and/or modified sequence opt5 from neuraminidase__InfluenzaB__AHL91688

SEQ ID NO: 212998 - RNA, 1401 nt, Artificial Sequence; identical to SEQ ID NO: 211711
  derived and/or modified sequence opt5 from neuraminidase__InfluenzaB__AHL91699

SEQ ID NO: 212999 - RNA, 1401 nt, Artificial Sequence
  derived and/or modified sequence opt5 from neuraminidase__InfluenzaB__AHL91710
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaaggaauguaaacacuuugcucucacacauuacgccgcgcagcccgggggauauuacaacggcaccagaggcgaccggaauaagcugcgccaccugaucagcgucaagcucgggaaaauuccuacaguggagaacucuaucuuccauauggccgcuugguccggaagcgccugccacgauggcaaggaguggaccuauauugggguugacggacccgauucuaaugcucugcuuaaaaucaaguacggcgaagccuacacggacacauaucacuccuacgcgaacaauauucugagaacccaggagagcgccuguaacugcaucgggggaaauuguuaucucaugauuacagauggcuccgcuucuggcaucagcgaaugccgguuucugaaaauccgcgaggggagaauuaucaaggagauuuucccgaccggacgggugaagcauaccgaagaguguacaugcggcuuugccuccaacaaaacgaucgaaugugcuugccgcgacaauagcuacaccgccaagagaccuuucgucaaacuuaacguggagacagauaccgccgaaauucggcugaugugcacagagaccuaucucgacacgccccgcccugaugacgggucuaucacaggacccugugaguccaauggcgauaaggggagcggaggcaucaaaggcggguuuguucaccaaagaauggcuucuaagauuggacggugguacagccgcaccauguccaaaaccaagagaaugggcauggggcuguaugugaaguacgacggagaccccuggacagauucugacgcgcuggcccucagcggcgucaugguguccauggaggaaccugggugguacagcuucggcuuugaaaucaaagauaagaaaugcgacgugccguguauuggaaucgagaugguccaugauggcgggaaggaaaccuggcacucugcugccacagccauuuauugccugaugggauccggccagcuucugugggacacgguuaccgggguggauauggcucucuga

SEQ ID NO: 213000 - RNA, 1401 nt, Artificial Sequence; identical to SEQ ID NO: 211638
  derived and/or modified sequence opt5 from neuraminidase__InfluenzaB__AHL91721

SEQ ID NO: 213001 - RNA, 1401 nt, Artificial Sequence; identical to SEQ ID NO: 211706
  derived and/or modified sequence opt5 from neuraminidase__InfluenzaB__AHL91732

SEQ ID NO: 213002 - RNA, 1401 nt, Artificial Sequence; identical to SEQ ID NO: 211638
  derived and/or modified sequence opt5 from neuraminidase__InfluenzaB__AHL91743

SEQ ID NO: 213003 - RNA, 1401 nt, Artificial Sequence
  derived and/or modified sequence opt5 from neuraminidase__InfluenzaB__AHL91754
augcugcccagcaccauccagacacucacgcugcuucugaccuccggcggggugcuccugucucuuuacgucagcgccucccugucuuaucuccuguacagcgacauucugcucaaguucuccccuacagagaucaccgcuccgacaaugccccuggauugcgccaacgcgucuaauguucaagcugugaacagaagcgccaccaaaggagugacacuucugcucccugaacccgaguggaccuauccucggcuguccugucccggcagcacguuucagaaggcccuucugauuucuccucaccgcuucggggaaaccaaaggaaauuccgcuccgcucaucauuagagagcccuuuaucgccugcggcccuaaggaauguaaacauuucgcucugacacacuacgccgcgcagcccgggggauauuacaacggcacccggggcgaccgcaauaagcugagacaucucaucagcgucaagcuggggaaaauuccuacaguggagaacucuaucuuucacauggccgcuugguccggaagcgccugccaugauggcaaggaguggaccuauauugggguugacggacccgauucuaaugcucugcuuaaaaucaaguacggcgaagccuacacggacacauaucacuccuacgcgaacaauauucuccggacccaggagagcgccuguaacugcaucgggggaaauuguuaucugaugauuacagauggcuccgcuucuggcaucagcgaaugccgcuuccuuaaaaucagagaggggcggauuaucaaggagauuuuuccgaccggacgcgugaagcacaccgaagaguguacaugcggcuucgccuccaacaaaacgaucgaaugugcuugcagagacaauagcuacaccgccaagcggccuuuugucaaacugaacguggagacagauaccgccgaaauucgccucaugugcacagagaccuaucuggacacgcccagaccugaugacgggucuaucacaggacccugugaguccaauggcgauaaggggagcggaggcaucaaaggcggguucguucaucaacggauggcuucuaagauuggacgcugguacagcagaaccauguccaaaaccaagcggaugggcauggggcuguaugugaaguacgacggagaccccuggacagauucugacgcgcucgcccugagcggcgucaugguguccauggaggaaccugggugguacagcuuuggcuucgaaaucaaagauaagaaaugcgacgugccguguauuggaaucgagaugguccacgauggcgggaaggaaaccuggcauucugcugccacagccauuuauugccuuaugggauccggccagcugcucugggacacgguuaccgggguggauauggcucuguga

SEQ ID NO: 213004 - RNA, 1401 nt, Artificial Sequence; identical to SEQ ID NO: 211638
  derived and/or modified sequence opt5 from neuraminidase__InfluenzaB__AHL91765

SEQ ID NO: 213005 - RNA, 1401 nt, Artificial Sequence
  derived and/or modified sequence opt5 from neuraminidase__InfluenzaB__AHL91776
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaccucuaucuuccacauggccgcuugguccggaagcgccugccaugauggcaaggaguggacguauauugggguugacggacccgauaacaaugcucugcuuaaaaucaaguacggcgaagccuacacagacaccuaucacucuuacgcgaacaauauucugcggacacaggaguccgccuguaacugcaucgggggaaauuguuaucucaugauuaccgauggcagcgcuuccggcgugucugaaugccgcuuucugaaaaucagagaggggcggaucauuaaggagaucuucccgaccggacgcgucaagcacacagaagaguguacgugcggcuuugccagcaacaaaaccauugaaugugcuugcagagacaauuccuacacagccaagcggccuuucgugaaacuuaacguugagaccgauacagccgaaauccgccugaugugcaccgagacguaucucgacacacccagaccugaugacgggagcauuaccggacccugugagucuaauggcgauaagggguccggaggcaucaaaggcggguuugugcaucaacggauggcuagcaagaucggacgcugguacucuagaaccaugagcaaaacagaacggaugggcauggggcuguaugucaaguacgacggagaccccugggcggauuccgacgcccuggcucucucuggcgugauggugagcauggaggaaccugggugguacuccuucggcuuugagauuaaggauaaaaagugcgacgucccguguaucggaauugaaaugguucacgauggcgggaaagagaccuggcauagcgccgccacagcuaucuauugccugaugggaucuggccagcuucugugggacacggugaccgggguggauauggcccucuga

SEQ ID NO: 213006 - RNA, 1401 nt, Artificial Sequence; identical to SEQ ID NO: 213005
  derived and/or modified sequence opt5 from neuraminidase__InfluenzaB__AHL91787

SEQ ID NO: 213007 - RNA, 1401 nt, Artificial Sequence; identical to SEQ ID NO: 213005
  derived and/or modified sequence opt5 from neuraminidase__InfluenzaB__AHL91798

SEQ ID NO: 213008 - RNA, 1401 nt, Artificial Sequence; identical to SEQ ID NO: 211642
  derived and/or modified sequence opt5 from neuraminidase__InfluenzaB__AHL91809

SEQ ID NO: 213009 - RNA, 1401 nt, Artificial Sequence
  derived and/or modified sequence opt5 from neuraminidase__InfluenzaB__AHL91820
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucauggugacagauggcagcgcuuccggcgucucugaaugccgcuuucugaagauuagagaggggcggaucaucaaagagauuuucccgaccggacgcgugaagcacaccgaagaguguacaugcggcuuugccagcaacaagacgaucgaaugugcuugcagagacaauuccuacaccgccaaacggccuuucguuaaacuuaacguggagacagauaccgccgaaauucgccugaugugcacagagaccuaucucgacacgcccagaccugaugacgggagcaucacaggacccugugagucuaacggcgauaagggguccggaggcauuaagggcggguuuguccaucaacggauggcuagcaaaaucggacgcugguacucuagaaccaugagcaagaccgaacggaugggcauggggcuguaugugaaauacgacggagaccccugggcggauuccgacgcccuggcucucucuggcgugauggucagcauggaggaaccugggugguacuccuucggcuuugagaucaaggauaagaaaugcgacguuccguguauuggaaucgaaauggugcacgauggcgggaaggagacauggcauagcgccgccaccgcuauuuauugccugaugggaucuggccagcuucugugggacacagugacgggggucgauauggcccucuga

SEQ ID NO: 213010 - RNA, 1401 nt, Artificial Sequence
  derived and/or modified sequence opt5 from neuraminidase__InfluenzaB__AHL91831
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcacaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagagaccuaucucgacacgcccagaccugaugacgggagcauuacaggacccugugagucuaacggcgauaagggguccggaggcaucaagggcggguuugugcaucaacggaugaccagcaaaaucggacgcugguacucuagaaccaugagcaagacagaacggaugggcauggggcuguaugucaaauacgacggagaccccugggcugauuccgacgcgcuggcccucucuggcgugauggugagcauggaggaaccugggugguacuccuucggcuuugagauuaaggauaagaaaugcgacgucccguguaucggaauugaaaugguucacgauggcgggaaggagaccuggcauagcgcugccacagccaucuauugccugaugggaucuggccagcuucugugggacacggugaccgggguggauauggcucucuga

SEQ ID NO: 213011 - RNA, 1401 nt, Artificial Sequence; identical to SEQ ID NO: 212155
  derived and/or modified sequence opt5 from neuraminidase__InfluenzaB__AHL91842

SEQ ID NO: 213012 - RNA, 1401 nt, Artificial Sequence
  derived and/or modified sequence opt5 from neuraminidase__InfluenzaB__AHL91853
augcugcccagcaccauccagacacucacgcuguuccuuaccuccggcggggugcugcucucucuguacgucagcgccucccuuucuuaucugcucuacagcgacauucugcugaaguuuuccacaaccgagaucacagcuccuaccaugccgucugauugcgccaacgcgagcaauguucaagcugugaacagauccgccacaaaaggagugacccuccugcuucccgaaccugaguggacguauccccggcugagcuguccuggcucuaccuuccagaaggcccuccugauuagcccccaccgcuuuggggaaacaaaaggaaauuccgcuccucuuaucauuagagagccguucaucgccugcggccccaaggaauguaaacauuuugcucugacccacuacgccgcgcagccugggggauauuacaacggcacacgggaggaccgcaauaagcucagacaucugaucucugucaagcugggcaaaauucccaccguggagaacuccaucuuccacauggccgcuuggagcgggucugccugccaugauggaaaggaauggacguauauuggcguugacgggccugauuccaaugcucuccugaaaaucaaguacggagaggccuacacagacaccuaucacagcuacgcgaacaauauucuucggacacaggaauccgccuguaacugcaucggcgggaauuguuaucugaugauuaccgauggaucugcuagcggcaucuccgagugccgcuuucucaaaaucagagagggccggauuaucaaggaaauuuuccccaccgggcgcgugaagcacacagaggaauguacgugcggauuugccagcaacaaaaccaucgagugugcuugcagagacaauucuuacacagccaagcggccguucgucaaacugaacguggaaaccgauacagccgagauucgccuuaugugcaccgagacguaucuggacacaccuagacccgaugacggcuccaucaccgggccuugugaaagcaauggaaacaagggcucugggggaaucaaaggcggcuuuguucaucaacggauggcuagcaagauugggcgcugguacuccagaaccaugucuaaaacaaagcggaugggaaugggccucuaugugaaguacgauggggaccccuggaccgacagcgaugcgcuggcccuguccggagucauggugagcauggaggaacccggcugguacucuuucggguuugagaucaaagacaagaaaugcgaugugccuuguauuggcaucgaaaugguccacgacggaggcaaggagacauggcauuccgcugccacggccauuuauugccucauggggagcggacagcugcuuugggauaccguuacaggcguggacauggcucuguga

SEQ ID NO: 213013 - RNA, 1401 nt, Artificial Sequence; identical to SEQ ID NO: 212153
  derived and/or modified sequence opt5 from neuraminidase__InfluenzaB__AHL91864

SEQ ID NO: 213014 - RNA, 1401 nt, Artificial Sequence; identical to SEQ ID NO: 212153
  derived and/or modified sequence opt5 from neuraminidase__InfluenzaB__AHL91875

SEQ ID NO: 213015 - RNA, 1401 nt, Artificial Sequence; identical to SEQ ID NO: 211910
  derived and/or modified sequence opt5 from neuraminidase__InfluenzaB__AHL91886

SEQ ID NO: 213016 - RNA, 1401 nt, Artificial Sequence; identical to SEQ ID NO: 211651
  derived and/or modified sequence opt5 from neuraminidase__InfluenzaB__AHL91897

SEQ ID NO: 213017 - RNA, 1401 nt, Artificial Sequence; identical to SEQ ID NO: 211651
  derived and/or modified sequence opt5 from neuraminidase__InfluenzaB__AHL91908

SEQ ID NO: 213018 - RNA, 1401 nt, Artificial Sequence
  derived and/or modified sequence opt5 from neuraminidase__InfluenzaB__AHL91919
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccacaaaaggagugacaccccugcuuccugaacccgaguggaccuauccucggcuguccugucccggcagcaccuuccagaaggcccuccugaucucuccucaccgcuuuggggaaacgaaaggaaauuccgcuccgcuuauuaucagagagcccuucaucgccugcggcccuaaggaauguaaacauuuugcucugacccacuacgccgcgcagcccgggggauauuacaacggcacacgggaggaccgcaauaagcucagacaucugauuagcgucaagcugggcaaaaucccuaccguggagaacucuauuuuccacauggccgcuugguccgggagcgccugccaugauggacgggaauggacauauaucggcguugacgggcccgauucuaaugcucuccugaagauuaaauacggagaggccuacaccgacacguaucacuccuacgcgaagaacauccuucgcacacaagaaagcgccuguaauugcauuggcggggauuguuaucugaugaucaccgacggaccggcuuccggcaucucugagugcagauuucucaaaauucgggagggccgcaucauuaaggaaaucuucccuacagggagagugaagcacaccgaggaauguaccugcggauuugccagcaacaaaacaauugagugugcuugccgggauaauuccuacacggccaagcgccccuucgucaaacugaacguggaaaccgacacagccgagaucagacuuaugugcaccgagacauaucuggauaccccucggcccaaugacggcagcaucacggggcccugugaaucuaacggagauaagggcuccgggggaauuaaaggcggcuuuguucaucagcgcauggcuagcaagaucgggagaugguacucucggacaaugagcaaaaccaagagaaugggaaugggccucuaugugaaguacgacggggacccuuggaccgauuccgaggcgcuggcccugucuggagucauggugagcauggaggaaccgggcugguacuccuucggguuugaaauuaaagacaagaaaugcgaugugcccuguaucggcauugagaugguccacgacggaggcaagacaaccuggcauagcgcugccacagccaucuauugccucauggggucuggacagcugcuuugggauacgguuaccggcguggacauggcucuguga

SEQ ID NO: 213019 - RNA, 1401 nt, Artificial Sequence; identical to SEQ ID NO: 212713
  derived and/or modified sequence opt5 from neuraminidase__InfluenzaB__AHL91930

SEQ ID NO: 213020 - RNA, 1401 nt, Artificial Sequence; identical to SEQ ID NO: 211651
  derived and/or modified sequence opt5 from neuraminidase__InfluenzaB__AHL91941

SEQ ID NO: 213021 - RNA, 1401 nt, Artificial Sequence; identical to SEQ ID NO: 211651
  derived and/or modified sequence opt5 from neuraminidase__InfluenzaB__AHL91952

SEQ ID NO: 213022 - RNA, 1401 nt, Artificial Sequence; identical to SEQ ID NO: 211694
  derived and/or modified sequence opt5 from neuraminidase__InfluenzaB__AHL91963

SEQ ID NO: 213023 - RNA, 1401 nt, Artificial Sequence
  derived and/or modified sequence opt5 from neuraminidase__InfluenzaB__AHL91974
augcugcccagcaccauccagacacucacgcuguuccuuaccuccggcggggugcugcucucucuguacgucagcgccucccuuucuuaucugcucuacagcgacauucugcugaaguuuuccccuacagagaucaccacaccgaccaugccccucgauugcgcuaacgccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaacgaauguaagcauuuugcccucacccacuacgcugcccagcccgggggauauuacaauggcacacggggcgaccgcaacaaacugagacaucugaucagcgucaagcucgggaagauuccuaccguggaaaauucuaucuuccacauggcggccugguccggaagcgcuugccaugauggcaaagaguggacguauauugggguugacggacccgauaacaaugcccugcuuaagaucaaauacggcgaggcuuacacagacaccuaucacucuuacgccaacaauauucugcggacacaggaguccgcguguaacugcaucgggggaaauuguuaucucaugauuaccgauggcagcgccuccggcgugucugaaugccgcuuucugaagaucagagaggggcggaucauuaaagagaucuucccgaccggacgcgucaagcacacagaagaguguacgugcggcuuugcuagcaacaagaccauugaaugugccugcagagacaauuccuacacagcuaaacggccuuucgugaaacuuaacguugagaccgauacagccgaaauccgccugaugugcaccgacacguaucucgauacacccagaccugacgaugggagcauuaccggacccugugagucuaacggcgacaagggguccggaggcaucaagggcggguuugugcaucaacggauggccagcaaaaucggacgcugguacucuagaaccaugagcaagacagagcggaugggcauggggcuguaugucaaauacgacggagaucccugggcugacuccgaugcgcuggccuucucuggcgugauggugagcaugaaggaaccugggugguacuccuuuggcuucgagauuaaggacaaaaagugcgaugucccguguaucggaauugaaaugguucacgacggcgggaaagagaccuggcauagcgcugccacagccaucuauugccucaugggaucuggccagcugcuuugggauacggugaccgggguggacauggcucuguga

SEQ ID NO: 213024 - RNA, 1401 nt, Artificial Sequence; identical to SEQ ID NO: 211694
  derived and/or modified sequence opt5 from neuraminidase__InfluenzaB__AHL91985

SEQ ID NO: 213025 - RNA, 1401 nt, Artificial Sequence; identical to SEQ ID NO: 211651
  derived and/or modified sequence opt5 from neuraminidase__InfluenzaB__AHL91995

SEQ ID NO: 213026 - RNA, 1401 nt, Artificial Sequence
  derived and/or modified sequence opt5 from neuraminidase__InfluenzaB__AHL92006
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaagaucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggcuagcaagaucggacgcugguacucuagaaccaugagcaaaaccgagcggaugggcauggggcuguaugucaaguacgacggagaucccugggcggacuccgaugcccuggcuuucucuggcgugauggugagcaugaaggaaccugggugguacuccuuuggcuucgagauuaaagacaagaaaugcgaugucccguguaucggaguugaaauggugcacgacggcgggaaggagacauggcauagcgccgccaccgcuauuuauugccucaugggaucuggccagcugcuuugggauacagugacgggggucgacauggcccuguga

SEQ ID NO: 213027 - RNA, 1401 nt, Artificial Sequence; identical to SEQ ID NO: 211659
  derived and/or modified sequence opt5 from neuraminidase__InfluenzaB__AHL92017

SEQ ID NO: 213028 - RNA, 1401 nt, Artificial Sequence; identical to SEQ ID NO: 211659
  derived and/or modified sequence opt5 from neuraminidase__InfluenzaB__AHL92028

SEQ ID NO: 213029 - RNA, 1401 nt, Artificial Sequence
  derived and/or modified sequence opt5 from neuraminidase__InfluenzaB__AHL92039
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggauuuauccucggcucuccugucccggcagcaccuuccaaaaggcccugcuuaucucuccucaucgcuuuggggaaacgaaaggaaauuccgcuccgcugauuaucagagagcccuucaucgccugcggcccuaacgaauguaagcacuuugcucucacccauuacgccgcgcagcccgggggauauuacaauggcacacggggcgaccgcaacaaacugagacaccugauuagcgucaagcucgggaagaucccuaccguggaaaauucuauuuuccauauggccgcuugguccggaagcgccugccacgauggcaaagaguggacauauaucgggguugacggacccgauaacaaugcucugcuuaagauuaaauacggcgaggccuacaccgacacguaucacucuuacgcgaacaauauccugcggacacaggaguccgccuguaacugcauugggggaaauuguuaucucaugaucaccgauggcagcgcuuccggcgugucugaaugccgcuuucugaagaucagagaggggcggauuaucaaagagauuuucccgacaggacgcgucaagcauaccgaagaguguaccugcggcuuugccagcaacaagacaaucgaaugugcuugcagagacaauuccuacacggccaaacggccuuucgugaaacuuaacguugagaccgauacagccgaaauucgccugaugugcaccgacacauaucucgauacccccagaccugacgaugggagcaucacgggacccugugagucuaacggcgacaagggguccggaggcaucaagggcggguuugugcaccagcggauggcuagcaaaauuggacgcugguacucuagaacaaugagcaagaccgagcggaugggcauggggcuguaugucaaauacaauggagaccccugggcggauuccgacgcccuggcuuucucuggcgugauggugagcaugaaggaaccugggugguacuccuuuggcuucgagaucaaggauaaaaagugcgacgucccguguauuggaaucgaaaugguucaugauggcgggaaagagaccuggcacagcgccgccacagcuauuuauugccucaugggaucuggccaacugcuuugggacaccgugacagggguggauauggcccuguga

SEQ ID NO: 213030 - RNA, 1401 nt, Artificial Sequence; identical to SEQ ID NO: 211659
  derived and/or modified sequence opt5 from neuraminidase__InfluenzaB__AHL92050

SEQ ID NO: 213031 - RNA, 1401 nt, Artificial Sequence
  derived and/or modified sequence opt5 from neuraminidase__InfluenzaB__AHL92061
augcugcccagcaccacacagacgcucacccuguuccuuacauccggcggggugcugcucucucuguacgucagcgccucccuuucuuaucugcucuacagcgacauccugcugaaguuuuccccuaccgagauuacagcuccgaccaugccccucgauugcgccaacgcgucuaauguucaagcugugaacagaagcgccacaaaaggagugacccugcuucugccugaacccgaguggacguauccucggcucuccugucccggcagcaccuuccagaaggcccugcuuaucucuccucaccgcuuuggggaaacaaaaggaaauuccgcuccgcugauuaucagagagcccuucauugccugcggcccuaacgaauguaagcauuuugcucucacccacuacgccgcgcagcccgggggauauuacaauggcacacggggcgaccgcaacaaacugagacaucugaucagcgucaagcucgggaagaucccuaccguggaaaauucuauuuuccacauggccgcuugguccggaagcgccugccaugauggcaaagaguggacguauaucgggguugacggacccgauaacaaugcucugcuuaagauuaaauacggcgaggccuacacagacaccuaucacucuuacgcgaacaagauccugcggacacaggaguccgccuguaauugcauugggggaaacuguuaucucaugaucaccgauggcagcgcuuccggcgugucugaaugccgcuuucugaaaauuagagaggggcggaucaucaaggagauuuucccgaccggacgcgucaagcacacagaagaguguacgugcggcuuugccagcaauaaaaccaucgaaugugcuugcagagacaacuccuacacagccaagcggccuuucgugaaacuuaauguugagaccgauacagccgaaauucgccugaugugcaccgacacguaucucgauacacccagaccugacgaugggagcaucaccggacccugugagucuaacggcgacaagggguccggaggcauuaaaggcggguuugugcaucaacggauggcuagcaagaucggacgcugguacucuagaaccaugagcaaaacagagcggaugggcauggggcuguaugucaaguacgacggagaucccugggcggacuccgaugcccuggcuuucucuggcgugauggugagcaugaaggaaccugggugguacuccuuuggcuucgagaucaaagacaagaaaugcgaugucccguguauuggaaucgaaaugguucacgacggcgggaaggagaccuggcauagcgccgccacagcuauuuauugccucaugggaucuggccagcugcuuugggauacggugaccgggguggacauggcccuguga

SEQ ID NO: 213032 - RNA, 1401 nt, Artificial Sequence
  derived and/or modified sequence opt5 from neuraminidase__InfluenzaB__AHL92072
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaacgaauguaagcacuuugcucucacacauuacgccgcgcagcccgggggauauuacaauggcaccagaggcgaccggaacaaacugcgccaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaagauucugagaacccaggaguccgccuguaauugcaucgggggaaacuguuaucucaugauuacagauggcagcgcuuccggcgugucugaaugccgguuucugaaaauccgcgaggggagaaucauuaaggagaucuucccgaccggacgggucaagcauaccgaagaguguacaugcggcuuugccagcaauaaaacgauugaaugugcuugccgcgacaacuccuacaccgccaagagaccuuucgugaaacuuaauguugagacagauaccgccgaaauccggcugaugugcacagacaccuaucucgauacgccccgcccugacgaugggagcauuacaggacccugugagucuaacggcgacaagggguccggaggcaucaaaggcggguuugugcaccaaagaauggcuagcaagaucggacggugguacucucgcaccaugagcaaaaccgagagaaugggcauggggcuguaugucaaguacgacggagaucccugggcggacuccgaugcccuggcuuucucuggcgugauggugagcaugaaggaaccugggugguacuccuuuggcuucgagauuaaagacaagaaaugcgaugucccguguaucggaauugaaaugguucaugacggcgggaaggagacauggcacagcgccgccaccgcuaucuauugccucaugggaucuggccagcugcuuugggauacagugacggggguggacauggcccuguga

SEQ ID NO: 213033 - RNA, 1401 nt, Artificial Sequence; identical to SEQ ID NO: 213032
  derived and/or modified sequence opt5 from neuraminidase__InfluenzaB__AHL92083

SEQ ID NO: 213034 - RNA, 1401 nt, Artificial Sequence; identical to SEQ ID NO: 213032
  derived and/or modified sequence opt5 from neuraminidase__InfluenzaB__AHL92094

SEQ ID NO: 213035 - RNA, 1401 nt, Artificial Sequence
  derived and/or modified sequence opt5 from neuraminidase__InfluenzaB__AHL92105
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaagcugaacguugagacagauaccgccgaaauccgccuuaugugcacagacaccuaucucgauacgcccagaccugacgaugggagcauuacaggacccugugagucuaacggcgacaaagggggaggcggcaucaaagggggauuugugcaccagcggauggcuuccaagaucggccgcugguacagcagaaccaugucuaagaccgagcggauggggaugggacuguaugucaaauacgacggcgaucccugggcggacagcgaugcccuggcuuucuccggggugauggugucucucaaggaaccuggcugguacagcuuuggauucgagauuaaggacaaaaagugcgaugucccguguaucggcauugaaaugguucaugacgggggaaaagagacauggcacuccgccgccaccgcuaucuauugccugaugggcagcgggcaacuucugugggauacagugacgggaguggacauggcccucuga

SEQ ID NO: 213036 - RNA, 1401 nt, Artificial Sequence; identical to SEQ ID NO: 211812
  derived and/or modified sequence opt5 from neuraminidase__InfluenzaB__AHL92116

SEQ ID NO: 213037 - RNA, 1401 nt, Artificial Sequence; identical to SEQ ID NO: 213032
  derived and/or modified sequence opt5 from neuraminidase__InfluenzaB__AHL92127

SEQ ID NO: 213038 - RNA, 1401 nt, Artificial Sequence; identical to SEQ ID NO: 213032
  derived and/or modified sequence opt5 from neuraminidase__InfluenzaB__AHL92138

SEQ ID NO: 213039 - RNA, 1401 nt, Artificial Sequence; identical to SEQ ID NO: 213032
  derived and/or modified sequence opt5 from neuraminidase__InfluenzaB__AHL92149

SEQ ID NO: 213040 - RNA, 1401 nt, Artificial Sequence
  derived and/or modified sequence opt5 from neuraminidase__InfluenzaB__AHL92171
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuugucucuccucaucgguuuggggaaaccaaaggaaauuccgcuccgcugauuauccgcgagcccuucauugccugcggcccuaacgaauguaagcacuuugcucucacacauuacgccgcgcagcccgggggauauuacaauggcaccagaggcgaccggaacaaacugcgccaccugaucagcgugaagcucgggaagaucccuacaguugaaaauucuauuuuccauauggccgcuugguccggaagcgccugccacgauggcaaagaguggaccuauaucgggguggacggacccgauaacaaugcucugcuuaagauuaaauacggcgaggccuacacggacacauaucacucuuacgcgaacaagauccugagaacccaggaguccgccuguaauugcauugggggaaacuguuaucucaugaucacagauggcagcgcuuccggcgucucugaaugccgguuucugaaaauucgcgaggggagaaucaucaaggagauuuucccgaccggacgggugaagcauaccgaagaguguacaugcggcuuugccagcaauaaaacgaucgaaugugcuugccgcgacaacuccuacaccgccaagagaccuuucguuaaacuuaauguggagacagauaccgccgaaauucggcugaugugcacagacaccuaucucgauacgccccgcccugacgaugggagcaucacaggacccugugagucuaacggcgacaagggguccggaggcauuaaaggcggguuuguccaccaaagaauggcuagcaagaucggacggugguacucucgcaccaugagcaaaaccgagagaaugggcauggggcuguaugugaaguacgacggagaucccugggcggacuccgaugcccuggcuuucucuggcgugauggucagcaugaaggaaccugggugguacuccuuuggcuucgagaucaaagacaagaaaugcgauguuccguguauuggaaucgaaauggugcaugacggcgggaaggagacauggcacagcgccgccaccgcuauuuauugccucaugggaucuggccagcugcuuugggauacagugacgggggucgacauggcccuguga

SEQ ID NO: 213041 - RNA, 1401 nt, Artificial Sequence
  derived and/or modified sequence opt5 from neuraminidase__InfluenzaB__AHL92182
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgagugggccuauccucggcucuccugucccggcagcaccuuccaaaaggcucugcuuauuucuccucaucgcuuuggggaaacgaaaggaaauuccgccccgcugaucauuagagagcccuucaucgcuugcggcccuaacgaauguaagcacuuugcccucacccauuacgcggcccagcccgggggauauuacagcggcacacggggcgaccgcaauaaacugagacaccugaucucugucaagcucgggaagauuccuaccguggagaacuccaucuuccauauggcugccuggagcggaucugcuugccacgauggcaaagaguggacauauauugggguugacggacccgauaauaacgcccugcuuaagaucaaauacggcgaagcguacaccgacacguaucacuccuacgccaauaacauucugcggacacaggagagcgcuuguaauugcaucgggggaaacuguuaucucaugauuaccgauggcuccgccucuggcgugagcgaaugccgcuuucugaagaucagagaggggcggaucauuaaagagaucuucccgacaggacgcgucaagcauaccgaagaguguaccugcggcuuugcuuccaauaagacaauugaaugugccugcagagacaacagcuacacggccaaacggccuuucgugaaacuuaauguugagaccgauacagcugaaauccgccugaugugcaccgacacauaucucgauacccccagaccugacgaugggucuauuacgggacccugugaguccaacggcgacaaggggagcggaggcaucaagggcggguuugugcaccagcggauggcgucuaaaaucggacgcugguacagcagaacaauguccaagaccgagcggaugggcauggggcuguaugucaaauacgacggagaucccugggccgacucugaugcucuggccuucagcggcgugaugguguccaugaaggaaccugggugguacagcuuuggcuucgagauuaaggacaaaaagugcgaugucccguguaucggaauugaaaugguucaugacggcgggaaagagaccuggcacucugccgcuacagccaucuauugccucaugggauccggccaacugcuuugggauaccgugacagggguggacauggcgcuguga

SEQ ID NO: 213042 - RNA, 1401 nt, Artificial Sequence; identical to SEQ ID NO: 213041
  derived and/or modified sequence opt5 from neuraminidase__InfluenzaB__AHL92193

SEQ ID NO: 213043 - RNA, 1401 nt, Artificial Sequence; identical to SEQ ID NO: 211812
  derived and/or modified sequence opt5 from neuraminidase__InfluenzaB__AHL92204

SEQ ID NO: 213044 - RNA, 1401 nt, Artificial Sequence
  derived and/or modified sequence opt5 from neuraminidase__InfluenzaB__AHL92215
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaacgaauguaagcacuuugcucucacacauuacgccgcgcagcccgggggauauuacaauggcaccagaggcgaccggaacaaacugcgccaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaagauucugagaacccaggaguccgccuguaauugcaucgggggaaacuguuaucucaugauuacagauggcagcgcuuccggcgugucugaaugccgguuucugaaaauccgcgaggggagaaucauuaaggagaucuucccgaagggacgggucaaacauaccgaagaguguaccugcggcuuugccagcaauaagacaauugaaugugcuugccgcgacaacuccuacacggccaaaagaccuuucgugaaacuuaauguugagaccgauacagccgaaauccggcugaugugcaccgacacauaucucgauacgccccgcccugacgaugggagcauuaccggacccugugagucuaacggcgacaagggguccggaggcaucaagggcggguuugugcaccaaagaauggcuagcaaaaucggacggugguacucucgcacaaugagcaagaccgagagaaugggcauggggcuguaugucaaguacgacggagaucccugggcggacuccgaugcccuggcuuucucuggcgugauggugagcaugaaagaaccugggugguacuccuuuggcuucgagauuaaggacaaaaagugcgaugucccguguaucggaauugaaaugguucaugacggcgggaaagagaccuggcacagcgccgccacagcuaucuauugccucaugggaucuggccagcugcuuugggauaccgugacagggguggacauggcccuguga

SEQ ID NO: 213045 - RNA, 1401 nt, Artificial Sequence; identical to SEQ ID NO: 213032
  derived and/or modified sequence opt5 from neuraminidase__InfluenzaB__AHL92226

SEQ ID NO: 213046 - RNA, 1401 nt, Artificial Sequence; identical to SEQ ID NO: 211812
  derived and/or modified sequence opt5 from neuraminidase__InfluenzaB__AHL92237

SEQ ID NO: 213047 - RNA, 1401 nt, Artificial Sequence; identical to SEQ ID NO: 213032
  derived and/or modified sequence opt5 from neuraminidase__InfluenzaB__AHL92248

SEQ ID NO: 213048 - RNA, 1401 nt, Artificial Sequence
  derived and/or modified sequence opt5 from neuraminidase__InfluenzaB__AHL92259
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuucuacaaugccgcucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucucugucaagcucgggaagauucccacaguggaaaauuccaucuuccacauggccgcuuggagcggaucugccugccaugauggcaaagaguggaccuauauugggguugacggaccugauaacgacgcucugcuuaagaucaaauacggcgaggccuacacggauacauaucacuccuacgcgaauaagauucugcggacccaggagagcgccuguaacugcaucgggggaaauuguuaucucaugauuacagacggcuccgcuucuggcgugagcgaaugccgcuuucugaaaaucagagaggggcggaucauuaaggagaucuuccccaccggacgcgucaagcacaccgaagaguguacaugcggcuuugccuccaacaaaacgauugaaugugcuugcagagauaauagcuacaccgccaagcggccguucgugaaacuuaacguugagacagacaccgccgaaauccgccugaugugcacagauaccuaucucgacacgccuagacccgaugacgggucuauuacaggaccuugugaguccaauggcgacaaggggagcggaggcaucaaaggcggguuugugcaucaacggaugaccucuaagaucggacgcugguacagcagaaccauguccaaaacagagcggaugggcauggggcuguaugucaaguacgauggagaccccugggcugauucugacgcgcuggccuucagcggcgugaugguguccaugaaggaacccgggugguacagcuuuggcuucgagauuaaagauaagaaaugcgacgucccuuguaucggaauugaaaugguucacgauggcgggaaggagaccuggcauucugcugccacagccaucuauugccucaugggauccggccagcugcuuugggacacggugaccgggguggauauggcucuguga

SEQ ID NO: 213049 - RNA, 1401 nt, Artificial Sequence; identical to SEQ ID NO: 213032
  derived and/or modified sequence opt5 from neuraminidase__InfluenzaB__AHL92270

SEQ ID NO: 213050 - RNA, 1401 nt, Artificial Sequence
  derived and/or modified sequence opt5 from neuraminidase__InfluenzaB__AHL92281
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugccaaccacagcgccaccaaaggagugacacugcuucugccugaacccgaguggaccuauccuagacucuccugucccggcagcacguuccagaaggcucugcuuauuucuccucaucgguuuggggaaaccaaaggaaauuccgccccgcugaucauucgcgagcccuucaucgcuugcggcccuaacgaauguaagcacuuugcccucacacauuacgcggcccagcccgggggauauuacaauggcaccagaggcgaccggaacaaacugcgccaccugaucagcgugaagcucgggaagauuccuacagucgaaaauucuaucuuccauauggcugccugguccggaagcgcuugccacgauggcaaagaguggaccuauauugggguggacggacccgauaacaaugcccugcuuaagaucaaauacggcgaggcguacacggacacauaucacucuuacgccaacaagauucugagaacccaggaguccgcuuguaauugcaucgggggaaacuguuaucucaugauuacagauggcagcgccuccggcguuucugaaugccgguuucugaaaauccgcgaggggagaaucauuaaggagaucuucccgaccggacgggugaagcauaccgaagaguguacaugcggcuuugcuagcaauaaaacgauugaaugugccugccgcgacaacuccuacaccgccaagagaccuuucgucaaacuuaauguggagacagauaccgcugaaauccggcugaugugcacagacaccuaucucgauacgccccgcccugacgaugggagcauuacaggacccugugagucuaacggcgacaagggguccggaggcaucaaaggcggguuuguucaccaaagaauggcgagcaagaucggacggugguacucucgcaccaugagcaaaaccgagagaaugggcauggggcuguaugugaaguacgacggagaucccugggccgacuccgaugcucuggccuucucuggcgucauggugagcaugaaggaaccugggugguacuccuuuggcuucgagauuaaagacaagaaaugcgaugugccguguaucggaauugaaaugguccaugacggcgggaaggagacauggcacagcgccgcuaccgccaucuauugccucaugggaucuggccagcugcuuugggauacaguuacggggguggacauggcgcuguga

SEQ ID NO: 213051 - RNA, 1401 nt, Artificial Sequence
  derived and/or modified sequence opt5 from neuraminidase__InfluenzaB__AHL92303
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacauuccugcuuccugaacccgaguggaccuauccucggcuguccugucccggcagcacguuucaaaaggcccuccugauuucuccucaucgcuucggggaaaccaaaggaaauuccgcuccgcuuaucauuagagagcccuuuaucgccugcggcccuaacgaauguaagcacuucgcucugacacauuacgccgcgcagcccgggggauauuacaauggcacccggggcgaccgcaacaaacucagacaccugaucagcgucaagcuggggaagauuccuacaguggaaaauucuaucuuucauauggccgcuugguccggaagcgccugccacgauggcaaagaguggaccuauauugggguugacggacccgauaacaaugcucuccugaagaucaaauacggcgaggccuacacggacacauaucacucuuacgcgaacaauauucuucggacccaggaguccgccuguaacugcaucgggggaaauuguuaucugaugauuacagauggcagcgcuuccggcgugucugaaugccgcuuccucaagaucagagaggggcggaucauuaaagagaucuuuccgaccggacgcgucaagcauaccgaagaguguacaugcggcuucgccagcaacaagacgauugaaugugcuugcagagacaauuccuacaccgccaaacggccuuuugugaagcugaacguugagacagauaccgccgaaauccgccuuaugugcacagacaccuaucuggauacgcccagaccugacgaugggagcauuacaggacccugugagucuaacggcaauaaaggguccggaggcaucaagggcggguucgugcaccagcggauggcuagcaaaaucggacgcugguacucuagaaccaugagcaagaccgagcggaugggcauggggcucuaugucaaauacgacggagaccccugggcggauuccgacgcccuggcuuuuucuggcgugauggugagcaugaaggaaccugggugguacuccuucggcuucgagauuaaggauaaaaagugcgacgucccguguaucggaauugaaaugguucaugauggcgggaaagagacauggcacagcgccgccaccgcuaucuauugccugaugggaucuggccaacuccugugggacacagugacggggguggauauggcccuuuga

SEQ ID NO: 213052 - RNA, 1401 nt, Artificial Sequence
  derived and/or modified sequence opt5 from neuraminidase__InfluenzaB__AHL92314
augcugcccagcaccauccagacacucacgcuguuccuuaccuccggcggggugcugcucucucuguacgucagcgccucccuuucuuaucugcucuacagcgacauucugcugaaguuuucccaaacaaaaaucaccgcuccuauuaugccgcucgauugcgccaacgcgucuaauguucaggcugugaacagaagcgccgccaagggagugacacugcuucugcccgagccugaauggaccuauccccggcucuccuguccuggcagcacauuccagaaagcucugcuuaucucuccccaccgcuuuggggagaccaagggaaauuccgccccucugauuaucagagaaccguucaucgcuugcggccccacggaguguaaacauuuugcccucacccacuacgcggcccagccugggggauauuacaacggcacacgggaagaccgcaauaagcugagacaucugauuagcgucaagcucggcaaaauccccaccguggagaacucuauuuuccacauggcugccugguccgggagcgcuugccaugauggaaaggaguggacauauguuggcguggacgggccugauucuaaugcccugcuuaaaaucaaguacggagaagcguacaccgacacguaucacuccuacgccaaaaacauucugcggacacaagagagcgcuuguaauugcaucggcggggauuguuaucucaugauuaccgacggacccgccuccggcaucucugaaugccgcuuucugaagaucagagagggccggauuaucaaggagauuuucccgacagggcgcgucaaacacaccgaagaguguaccugcggauuugcuagcaacaagacaaucgaaugugccugcagagauaauuccuacacggccaaacggccuuucgugaaacuuaacguugagaccgacacagcugaaauucgccugaugugcaccgagacauaucucgauacccccagaccuaaugacggcagcaucacggggcccugugagucugauggagacaagggcuccgggggaaucaagggcggcuuugugcaucagcggauggcgagcaaaauugggcgcugguacucuagaacaaugagcaagaccaagcggaugggaaugggccuguaugucaaauacgacggggaucccuggaccgacuccgaagcccuggcucucucuggagugauggugagcauggaugagccuggcugguacuccuucggguuugaaaucaaggacaaaaagugcgaugucccguguauuggcaucgagaugguucacgacggaggcaaaacaaccuggcauagcgccgccacagcuauuuauugccugauggggucuggacagcuucugugggauacggugaccggcguggacauggcccucuga

SEQ ID NO: 213053 - RNA, 1401 nt, Artificial Sequence
  derived and/or modified sequence opt5 from neuraminidase__InfluenzaB__AHL92325
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucauggugagcaugggcgaaccugggugguacuccuucggcuuugagauuaaagauaagaaaugcgacgugccguguaucggaauugaaaugguccacgauggcgggaagacaaccuggcauagcgccgccacagcuaucuauugccugaugggaucuggccagcuucugugggacacgguuaccgggguggauauggcccucuga

SEQ ID NO: 213054 - RNA, 1401 nt, Artificial Sequence; identical to SEQ ID NO: 211812
  derived and/or modified sequence opt5 from neuraminidase__InfluenzaB__AHL92336

SEQ ID NO: 213055 - RNA, 1401 nt, Artificial Sequence
  derived and/or modified sequence opt5 from neuraminidase__InfluenzaB__AHL92358
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccaaggaauguaaacauuuugcccucacgcacuacgcggcccagccugggggauauuacaacggcacccgggaggaccgcaauaagcugagacaucugauuagcgucaagcucggcaaaauccccacaguggagaacucuauuuuccacauggcugccugguccgggagcgcuugccaugauggaaaggaauggaccuauguuggcguggacgggccugauucuaaugcccugcuuaaaaucaaguacggagaggcguacacagacaccuaucacuccuacgccaaaaacauucugcggacgcaagaaagcgcuuguaauugcaucggcggggauuguuaucucaugauuacagacggacccgccuccggcaucucugagugccgcuuucugaagaucagagagggccggauuaucaaggaaauuuucccgaccgggcgcgucaaacacacagaggaauguaccugcggauuugcuagcaacaagaccaucgagugugccugcagagauaauuccuacacagccaaacggccuuucgugaaacuuaacguugaaacggacaccgcugagauucgccugaugugcacagagaccuaucucgauacacccagaccuaaugacggcagcaucaccgggcccugugaaucugauggagacaagggcuccgggggaaucaagggcggcuuugugcaucagcggauggcgagcaaaauugggcgcugguacucuagaacgaugagcaagacaaagcggaugggaaugggccuguaugucaaauacgacggggaucccuggaccgacuccgaggcccuggcucucucuggagugauggugagcauggaggaaccuggcugguacuccuucggguuugaaaucaaggauaaaaagugcgacgucccguguauuggcaucgagaugguucacgauggaggcaaaaccacauggcauagcgccgccaccgcuauuuauugccugauggggucuggacagcuucugugggacacagugacgggcguggauauggcccucuga

SEQ ID NO: 213056 - RNA, 1401 nt, Artificial Sequence; identical to SEQ ID NO: 213055
  derived and/or modified sequence opt5 from neuraminidase__InfluenzaB__AHL92369

SEQ ID NO: 213057 - RNA, 1401 nt, Artificial Sequence
  derived and/or modified sequence opt5 from neuraminidase__InfluenzaB__AHL92380
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugaagcugcuucugcccgaaccugaguggaccuauccccgccucuccuguccuggcagcacauuccagaaagcccugcuuaucucuccccacagauuuggggaaaccaagggaaauuccgcuccucugauuauccgggagccguucaucgccugcggccccaaagaauguaagcauuuugcucucacgcacuacgccgcgcagccugggggauauuacaacggcacccgcgaggacagaaauaagcugcggcaucugauuagcgucaaacucggcaagauccccacaguggagaacucuauuuuccacauggccgcuugguccgggagcgccugccaugauggacgcgaauggaccuauaucggcguugacgggccugauucuaaugcucugcuuaaaauuaaguacggagaggccuacacagacaccuaucacuccuacgcgaaaaacauccugagaacgcaggaaagcgccuguaauugcauuggcggggauuguuaucucaugaucacagacggacccgcuuccggcaucucugagugccgguuucugaagauucgcgagggcagaaucauuaaggaaaucuucccgaccgggcgggugaaacacacagaggaauguaccugcggauuugccagcaacaagaccauugagugugcuugccgcgauaauuccuacacagccaaaagaccuuucgucaaacuuaacguggaaacggacaccgccgagauccggcugaugugcacagagaccuaucucgauacaccccgcccuaaugacggcagcaucaccgggcccugugaaucuaacggagauaagggcuccgggggaauuaagggcggcuuuguucaucaaagaauggcuagcaaaaucgggcggugguacucuagaacgaugagcaagacaaagcgcaugggaaugggccuguaugugaaauacgacggggaccccuggaccgauuccgaggcgcuggcccucucuggagucauggugagcauggaggaaccuggcugguacuccuucggguuugaaauuaaggacaaaaagugcgaugugccguguaucggcauugagaugguccacgacggaggcaaaaccacauggcauagcgcugccaccgccaucuauugccugauggggucuggacagcuucugugggauacaguuacgggcgugaauaugacccucuga

SEQ ID NO: 213058 - RNA, 1401 nt, Artificial Sequence
  derived and/or modified sequence opt5 from neuraminidase__InfluenzaB__AHL92391
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaagcaagcugcggcaucugauuucugucaagcucggcaaaauccccaccguggaaaauuccauuuuccacauggccgcuuggagcgggucugccugccaugauggacgcgaauggacauauaucggcguugacgggccugauuccaacgcucugcuuaagauuaaauacggagaggccuacaccgacacguaucacagcuacgcgaagaauauccugagaacacaggaauccgccuguaacugcauuggcggggauuguuaucucaugaucaccgacggacccgcuucuggcaucagcgagugccgguuucugaaaauucgcgagggcagaaucauuaaggaaaucuucccgacagggcgggugaagcacaccgaggaauguaccugcggauuugccuccaauaaaacaauugagugugcuugccgcgauaacagcuacacggccaagagaccuuucgucaaacuuaauguggaaaccgacacagccgagauccggcugaugugcaccgagacauaucucgauacgccccgcccuaacgacggcucuaucaccgggcccugugaauccaauggagauaagggcagcgggggaauuaaaggcggcuuuguucaucaaagaauggcuucuaagaucgggcggugguacagcagaacaauguccaaaaccaagcgcaugggaaugggccuguaugugaaguacgacggggaccccuggaccgauucugaggcgcuggcccucagcggagucaugguguccauggaggagccuggcugguacagcuucggguuugaaauuaaagacaagaaaugcgaugugccguguaucggcauugagaugguccacgacggaggcaagacaaccuggcauucugcugccacagccaucuauugccugaugggguccggacagcuucugugggauacgguuaccggcgugaacaugacacucuga

SEQ ID NO: 213059 - RNA, 1401 nt, Artificial Sequence; identical to SEQ ID NO: 211841
  derived and/or modified sequence opt5 from neuraminidase__InfluenzaB__AHL92402

SEQ ID NO: 213060 - RNA, 1401 nt, Artificial Sequence; identical to SEQ ID NO: 211841
  derived and/or modified sequence opt5 from neuraminidase__InfluenzaB__AHL92413

SEQ ID NO: 213061 - RNA, 1401 nt, Artificial Sequence; identical to SEQ ID NO: 211841
  derived and/or modified sequence opt5 from neuraminidase__InfluenzaB__AHL92424

SEQ ID NO: 213062 - RNA, 1401 nt, Artificial Sequence
  derived and/or modified sequence opt5 from neuraminidase__InfluenzaB__AHL92435
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcaucucugagugccgcuuucugaaaauuagagagggccggaucauuaaggaaaucuucccgacagggcgcgugaagcacaccgaggaauguaccugcggauuugcuagcaacaaaacaauugagugugccugcagagauaauuccuacacggccaagcggccuuucgucaaacuuaacguggaaaccgacacagcugagauccgccugaugugcaccgagacauaucucgauacccccagaccuaaugacggcagcaucacggggcccugugaaucugauggagacaagggcuccgggggaauuaaaggcggcuuuguucaucagcggauggcgagcaagaucgggcgcugguacucuagaacaaugagcaaaaccaagcggaugggaaugggccuguaugugaaguacgacggggaucccuggaccgacuccgaggcccuggcucucucuggagucaugauuagcauggaggaaccuggcugguacuccuucggguuugaaaucaaagauaagaaaugcgacgugccguguauuggcaucgagauggugcacgauggaggcaagacaaccuggcauagcgccgccacagcuaucuauugccugauggggucuggacagcuucugugggacacggucaccggcguugauauggcccucuga

SEQ ID NO: 213063 - RNA, 1401 nt, Artificial Sequence; identical to SEQ ID NO: 211841
  derived and/or modified sequence opt5 from neuraminidase__InfluenzaB__AHL92446

SEQ ID NO: 213064 - RNA, 1401 nt, Artificial Sequence; identical to SEQ ID NO: 211841
  derived and/or modified sequence opt5 from neuraminidase__InfluenzaB__AHL92457

SEQ ID NO: 213065 - RNA, 1401 nt, Artificial Sequence; identical to SEQ ID NO: 211841
  derived and/or modified sequence opt5 from neuraminidase__InfluenzaB__AHL92468

SEQ ID NO: 213066 - RNA, 1401 nt, Artificial Sequence; identical to SEQ ID NO: 211841
  derived and/or modified sequence opt5 from neuraminidase__InfluenzaB__AHL92479

SEQ ID NO: 213067 - RNA, 1401 nt, Artificial Sequence; identical to SEQ ID NO: 211812
  derived and/or modified sequence opt5 from neuraminidase__InfluenzaB__AHL92490

SEQ ID NO: 213068 - RNA, 1401 nt, Artificial Sequence; identical to SEQ ID NO: 211841
  derived and/or modified sequence opt5 from neuraminidase__InfluenzaB__AHL92501

SEQ ID NO: 213069 - RNA, 1401 nt, Artificial Sequence
  derived and/or modified sequence opt5 from neuraminidase__InfluenzaB__AHL92512
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacaugguugccugguccgggagcgcuugccaugauggacgcgaauggacauauaucggcguggacgggccugauucuaaugcccugcuuaagauuaaauacggagaggcuuacaccgacacguaucacuccuacgccaagaacauccugagaacacaggaaagcgcguguaauugcauuggcggggauuguuaucucaugaucaccgacggacccgccuccggcaucucugagugccgguuucugaaaauucgcgagggcagaaucauuaaggaaaucuucccgacagggcgggucaagcacaccgaggaauguaccugcggauuugcuagcaacaaaacaauugagugugccugccgcgauaauuccuacacggcuaagagaccuuucgugaaacuuaacguugaaaccgacacagccgagauccggcugaugugcaccgagacauaucucgauacgccccgcccuaaugacggcagcaucaccgggcccugugaaucuaacggagauaagggcuccgggggaauuaaaggcggcuuugugcaucaaagaauggccagcaagaucgggcggugguacucuagaacaaugagcaaaaccaagcgcaugggaaugggccuguaugucaaguacgacggggaccccuggaccgauuccgaggcucuggcgcucucuggagugauggugagcauggaggaaccuggcugguacuccuucggguuugaaauuaaagacaagaaaugcgaugucccguguaucggcauugagaugguucacgacggaggcaagacaaccuggcauagcgccgcuacagccaucuauugccugauggggucuggacagcuucugugggauacggugaccggcgugaauaugacacucuga

SEQ ID NO: 213070 - RNA, 1401 nt, Artificial Sequence; identical to SEQ ID NO: 211841
  derived and/or modified sequence opt5 from neuraminidase__InfluenzaB__AHL92523

SEQ ID NO: 213071 - RNA, 1401 nt, Artificial Sequence; identical to SEQ ID NO: 211841
  derived and/or modified sequence opt5 from neuraminidase__InfluenzaB__AHL92534

SEQ ID NO: 213072 - RNA, 1401 nt, Artificial Sequence; identical to SEQ ID NO: 211812
  derived and/or modified sequence opt5 from neuraminidase__InfluenzaB__AHL92545

SEQ ID NO: 213073 - RNA, 1401 nt, Artificial Sequence; identical to SEQ ID NO: 211841
  derived and/or modified sequence opt5 from neuraminidase__InfluenzaB__AHL92556

SEQ ID NO: 213074 - RNA, 1401 nt, Artificial Sequence; identical to SEQ ID NO: 211841
  derived and/or modified sequence opt5 from neuraminidase__InfluenzaB__AHL92567

SEQ ID NO: 213075 - RNA, 1401 nt, Artificial Sequence; identical to SEQ ID NO: 211841
  derived and/or modified sequence opt5 from neuraminidase__InfluenzaB__AHL92578

SEQ ID NO: 213076 - RNA, 1401 nt, Artificial Sequence; identical to SEQ ID NO: 211812
  derived and/or modified sequence opt5 from neuraminidase__InfluenzaB__AHL92589

SEQ ID NO: 213077 - RNA, 1401 nt, Artificial Sequence; identical to SEQ ID NO: 211841
  derived and/or modified sequence opt5 from neuraminidase__InfluenzaB__AHL92600

SEQ ID NO: 213078 - RNA, 1401 nt, Artificial Sequence; identical to SEQ ID NO: 212868
  derived and/or modified sequence opt5 from neuraminidase__InfluenzaB__AHL92611

SEQ ID NO: 213079 - RNA, 1401 nt, Artificial Sequence
  derived and/or modified sequence opt5 from neuraminidase__InfluenzaB__AHL92622
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugaccuuccugcuucccgaaccugaguggacauauccccgccuguccuguccuggcagcaccuuucagaaggcccuccugaucucuccccacagauucggggaaacgaaaggaaauuccgcuccucuuauuauccgggagccguuuaucgccugcggccccaaggaauguaaacauuucgcucugacccacuacgccgcgcagccugggggauauuacaacggcacacgcgaggacagaaauaagcuccggcaucugauuagcgucaagcugggcaaaauccccaccguggagaacucuauuuuucacauggccgcuugguccgggagcgccugccaugauggacgcgaauggacauauaucggcguugacgggccugauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggacccgcuuccggcaucucugagugccgguuccucaaaauucgcgagggcagaaucauuaaggaaaucuuuccgacagggcgggugaagcacaccgaggaauguaccugcggauucgccagcaacaaaacaauugagugugcuugccgcgauaauuccuacacggccaagagaccuuuugucaaacugaacguggaaaccgacacagccgagauccggcuuaugugcaccgagacauaucuggauacgccccgcccuaaugacggcagcaucaccgggcccugugaaucuaacggagauaagggcuccgggggaauuaaaggcggcuucguucaucaaagaauggcuagcaagaucgggcggugguacucuagaacaaugagcaaaaccaagcgcaugggaaugggccucuaugugaaguacgacggggaccccuggaccgauuccgaggcgcuggcccugucuggagucauggugagcauggaggaaccuggcugguacuccuuuggguucgaaauuaaagacaagaaaugcgaugugccguguaucggcauugagaugguccacgacggaggcaagacaaccuggcauagcgcugccacagccaucuauugccucauggggucuggacagcugcuuugggauacgguuaccggcgugaauaugacacuguga

SEQ ID NO: 213080 - RNA, 1401 nt, Artificial Sequence
  derived and/or modified sequence opt5 from neuraminidase__InfluenzaB__AHL92633
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugaccuuccugcuucccgaaccugaguggacauauccccgccuguccuguccuggcagcaccuuucagaaggcccuccugaucucuccccacagauucggggaaacgaaaggaaauuccgcuccucuuauuauccgggagccguuuaucgccugcggccccaaggaauguaaacauuucgcucugacccacuacgccgcgcagccugggggauauuacaacggcacacgcgaggacagaaauaagcuccggcaucugauuagcgucaagcugggcaaaauccccauuguggagaacucuaucuuucacauggccgcuugguccgggagcgccugccaugauggacgcgaauggaccuauauuggcguugacgggccugauucuaaugcucuccugaagaucaaauacggagaggccuacacagacaccuaucacuccuacgcgaagaacauucuuagaacgcaggaaagcgccuguaauugcaucggcggggauuguuaucugaugaucacagacggacccgcuuccggcauuucugagugccgguuccucaaaauccgcgagggcagaauuaucaaggaaauuuuuccgaccgggcgggugaagcacacagaggaauguaccugcggauucgccagcaacaaaaccaucgagugugcuugccgcgauaauuccuacacagccaagagaccuuuugucaaacugaacguggaaacggacaccgccgagauccggcuuaugugcacagagaccuaucuggauacaccccgcccuaaugacggcagcauuaccgggcccugugaaucuaacggagauaagggcuccgggggaaucaaaggcggcuucguucaucaaagaauggcuagcaagauugggcggugguacucuagaacgaugagcaaaacaaagcgcaugggaaugggccucuaugugaaguacgacggggaccccuggaccgauuccgaggcgcuggcccugucuggagucauggugagcauggaggaaccuggcugguacuccuuuggguucgaaaucaaagacaagaaaugcgaugugccguguauuggcaucgagaugguccacgacggaggcaagaccacauggcauagcgcugccaccgccaucuauugccucauggggucuggacagcugcuuugggauacaguuacgggcgugaauaugacccuguga

SEQ ID NO: 213081 - RNA, 1401 nt, Artificial Sequence; identical to SEQ ID NO: 211812
  derived and/or modified sequence opt5 from neuraminidase__InfluenzaB__AHL92644

SEQ ID NO: 213082 - RNA, 1401 nt, Artificial Sequence; identical to SEQ ID NO: 211812
  derived and/or modified sequence opt5 from neuraminidase__InfluenzaB__AHL92655

SEQ ID NO: 213083 - RNA, 1401 nt, Artificial Sequence; identical to SEQ ID NO: 211841
  derived and/or modified sequence opt5 from neuraminidase__InfluenzaB__AHL92666

SEQ ID NO: 213084 - RNA, 1401 nt, Artificial Sequence; identical to SEQ ID NO: 211841
  derived and/or modified sequence opt5 from neuraminidase__InfluenzaB__AHL92677

SEQ ID NO: 213085 - RNA, 1401 nt, Artificial Sequence; identical to SEQ ID NO: 211812
  derived and/or modified sequence opt5 from neuraminidase__InfluenzaB__AHL92688

SEQ ID NO: 213086 - RNA, 1401 nt, Artificial Sequence; identical to SEQ ID NO: 211841
  derived and/or modified sequence opt5 from neuraminidase__InfluenzaB__AHL92699

SEQ ID NO: 213087 - RNA, 1401 nt, Artificial Sequence; identical to SEQ ID NO: 211841
  derived and/or modified sequence opt5 from neuraminidase__InfluenzaB__AHL92710

SEQ ID NO: 213088 - RNA, 1401 nt, Artificial Sequence; identical to SEQ ID NO: 211841
  derived and/or modified sequence opt5 from neuraminidase__InfluenzaB__AHL92721

SEQ ID NO: 213089 - RNA, 1401 nt, Artificial Sequence; identical to SEQ ID NO: 211841
  derived and/or modified sequence opt5 from neuraminidase__InfluenzaB__AHL92732

SEQ ID NO: 213090 - RNA, 1401 nt, Artificial Sequence; identical to SEQ ID NO: 211841
  derived and/or modified sequence opt5 from neuraminidase__InfluenzaB__AHL92743

SEQ ID NO: 213091 - RNA, 1401 nt, Artificial Sequence; identical to SEQ ID NO: 211841
  derived and/or modified sequence opt5 from neuraminidase__InfluenzaB__AHL92754

SEQ ID NO: 213092 - RNA, 1401 nt, Artificial Sequence; identical to SEQ ID NO: 211841
  derived and/or modified sequence opt5 from neuraminidase__InfluenzaB__AHL92765

SEQ ID NO: 213093 - RNA, 1401 nt, Artificial Sequence; identical to SEQ ID NO: 211841
  derived and/or modified sequence opt5 from neuraminidase__InfluenzaB__AHL92776

SEQ ID NO: 213094 - RNA, 1401 nt, Artificial Sequence; identical to SEQ ID NO: 211841
  derived and/or modified sequence opt5 from neuraminidase__InfluenzaB__AHL92787

SEQ ID NO: 213095 - RNA, 1401 nt, Artificial Sequence; identical to SEQ ID NO: 211841
  derived and/or modified sequence opt5 from neuraminidase__InfluenzaB__AHL92798

SEQ ID NO: 213096 - RNA, 1401 nt, Artificial Sequence
  derived and/or modified sequence opt5 from neuraminidase__InfluenzaB__AHL92809
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccaucaaaggagugacacugcuucugcccgaaccugaguggaccuauccccgccucuccuguccuggcagcacauuccagaaggcccugcuuauuucuccccacagauuuggggaaaccaaaggaaauuccgcuccucugaucauccgggagccguucauugccugcggccccaaggaauguaaacauuuugcucucacgcacuacgccgcgcagccugggggauauuacaacggcacccgcgaggacagaaauaagcugcggcaucugaucagcgucaagcucggcaaaauucccacaguggagaacucuaucuuccacauggccgcuugguccgggagcgccugccaugauggacgcgaauggaccuauauuggcguugacgggccugauucuaaugcucugcuuaagaucaaauacggagaggccuacacagacaccuaucacuccuacgcgaagaacauucugagaacgcaggaaagcgccuguaauugcaucggcggggauuguuaucucaugaucacagacggacccgcuuccggcauuucugagugccgguuucugaaaauccgcgagggcagaauuaucaaggaaauuuucccgaccgggcgggugaagcacacagaggaauguaccugcggauuugccagcaacaaaaccaucgagugugcuugccgcgauaauuccuacacagccaagagaccuuucgucaaacuuaacguggaaacggacaccgccgagauccggcugaugugcacagagaccuaucucgauacaccccgcccuaaugacggcagcauuaccgggcccugugaaucuaacggagauaagggcuccgggggaaucaaaggcggcuuuguucaucaaagaauggcuagcaagauugggcggugguacucuagaacgaugagcaaaacaaagcgcaugggaaugggccuguaugugaaguacgacggggaccccuggaccgauuccgaggcgcuggcccucucuggagucauggugagcauggaggaaccuggcugguacuccuucggguuugaaaucaaagacaagaaaugcgaugugccguguauuggcaucgagaugguccacgacggaggcaagaccacauggcauagcgcugccaccgccaucuauugccugauggggucuggacagcuucugugggauacaguuacgggcgugaauaugacccucuga

SEQ ID NO: 213097 - RNA, 1401 nt, Artificial Sequence
  derived and/or modified sequence opt5 from neuraminidase__InfluenzaB__AHL92820
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacccugcuucugcccgaaccugaguggacauauccccgccucuccuguccuggcagcaccuuccagaaggcccugcuuaucucuccccacagauuuggggaaacgaaaggaaauuccgcuccucugauuauccgggagccguucaucgccugcggccccaaggaauguaaacauuuugcucucacccacuacgccgcgcagccugggggauauuacaacggcacacgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauucuaaugcucugcuuaagauuaaauacggagaggccuacaccgacacguaucacuccuacgcgaagaacauccugagaacacaggaaagcgccuguaauugcauuggcggggauuguuaucucaugaucaccgacggacccgcuuccggcaucucugagugccgguuucugaaaauucgcgagggcagaaucauuaaggaaaucuucccgacagggcgggugaagcacaccgaggaauguaccugcggauuugccagcaacaaaacaauugagugugcuugccgcgauaauuccuacacggccaagagaccuuucgucaaacuuaacguggaaaccgacacagccgagauccggcugaugugcaccgagacauaucucgauacgccccgcccuaaugacggcagcaucaccgggcccugugaaucuaacggagauaagggcuccgggggaauuaaaggcggcuuuguucaucaaagaauggcuagcaagaucgggcggugguacucuagaacaaugagcaaaaccaagcgcaugggaaugggccuguaugugaaguacgacggggaccccuggaccgauuccgaggcgcuggcccucucuggagucauggugagcauggaggaaccuggcugguacuccuucggguuugaaauuaaagacaagaaaugcgaugugccguguaucggcauugagaugguccacgacggaggcaagaaaacauggcauagcgcugccaccgccaucuauugccugauggggucuggacagcuucugugggauacaguuacgggcgugaauaugacccucuga

SEQ ID NO: 213098 - RNA, 1401 nt, Artificial Sequence
  derived and/or modified sequence opt5 from neuraminidase__InfluenzaB__AHL92842
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcacaaccaaaggagugacacugcuucugcccgaaccugaguggaccuauccccgccucuccuguccuggcagcacguuccagaaggcccugcuuaucucuccccacagauuuggggaaaccaaaggaaauuccgccccucugauuauccgggagccguucaucgcuugcggccccaaggaauguaaacauuuugcccucacacacuacgcugcccagccugggggauauuacaacggcacccgcgaggacagaaauaagcugcggcaucugauuagcgucaagcucggcaaaauccccacaguggagaacucuauuuuccacauggcggccugguccgggagcgcuugccaugauggacgcgaauggaccuauaucggcguugacgggccugauucuaaugcccugcuuaagauuaaauacggagaggcuuacacggacacauaucacuccuacgccaagaacauccugagaacccaggaaagcgcguguaauugcauuggcggggauuguuaucucaugaucacagacggacccgccuccggcaucucugagugccgguuucugaaaauucgcgagggcagaaucauuaaggaaaucuucccgaccgggcgggugaagcacaccgaggaauguacaugcggauuugcuagcaacaaaacgauugagugugccugccgcgauaauuccuacaccgcuaagagaccuuucgucaaacuuaacguggaaacagacaccgccgagauccggcugaugugcacagagaccuaucucgauacgccccgcccuaaugacggcagcaucacagggcccugugaaucuaacggagauaagggcuccgggggaauuaaaggcggcuuuguucaucaaagaauggccagcaagaucgggcggugguacucuagaaccaugagcaaaaccaagcgcaugggaaugggccuguaugugaaguacgacggggaccccuggacagauuccgaggcucuggcgcucucuggagucauggugagcauggaggaaccuggcugguacuccuucggguuugaaauuaaagacaagaaaugcgaugugccguguaucggcauugagaugguccacgacggaggcaagaccacauggcauagcgccgcuacggccaucuauugccugauggggucuggacagcuucugugggauaccguuacaggcgugaauaugacccucuga

SEQ ID NO: 213099 - RNA, 1401 nt, Artificial Sequence; identical to SEQ ID NO: 211841
  derived and/or modified sequence opt5 from neuraminidase__InfluenzaB__AHL92853

SEQ ID NO: 213100 - RNA, 1401 nt, Artificial Sequence; identical to SEQ ID NO: 211841
  derived and/or modified sequence opt5 from neuraminidase__InfluenzaB__AHL92864

SEQ ID NO: 213101 - RNA, 1401 nt, Artificial Sequence; identical to SEQ ID NO: 211694
  derived and/or modified sequence opt5 from neuraminidase__InfluenzaB__AHL92875

SEQ ID NO: 213102 - RNA, 1401 nt, Artificial Sequence; identical to SEQ ID NO: 211651
  derived and/or modified sequence opt5 from neuraminidase__InfluenzaB__AHL92886

SEQ ID NO: 213103 - RNA, 1401 nt, Artificial Sequence
  derived and/or modified sequence opt5 from neuraminidase__InfluenzaB__AHL92897
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaauuccccucgauugcgccaacgcgucuaauguucaagcugugaacagaagcgccaccaaaggagugacacugcuucugccugaacccgaguggaccuauccucggcucuccugucccggcagcacguuccagaaggcccugcuuaucucuccucaccgcuuuggggaaaccaaaggaaauuccgcuccgcugauuaucagagagcccuucaucgccugcggcccuaacgaauguaagcauuuugcucucacacacuacgccgcgcagcccgggggauauuacaauggcacccggggcgaccgcaacaaacugagacaucugauuagcgucaagcucgggaagaucccuacaguggaaaauucuauuuuccacauggccgcuugguccggaagcgccugccaugauggcaaagaguggaccuauaucgggguugacggacccgauaacaaugcucugcuuaagauuaaauacggcgaggccuacacggacacauaucacucuuacgcgaacaauauccugcggacccaggaguccgccuguaacugcauugggggaaauuguuaucucaugaucacagauggcagcgcuuccggcgugucugaaugccgcuuucugaagaucagagaggggcggauuaucaaagagauuuucccgaccggacgcgucaagcacaccgaagaguguacaugcggcuuugccagcaacaagacgaucgaaugugcuugcagagacaauuccuacaccgccaaacggccuuucgugaaacuuaacguugagacagauaccgccgaaauucgccugaugugcacagacaccuaucucgauacgcccagaccugacgaugggagcaucacaggacccugugagucuaacggcgacaagggguccggaggcaucaagggcggguuugugcaucaacggauggcuagcaaaauuggacgcugguacucuagaaccaugagcaagaccgagcggaugggcauggggcuguaugucaaauacgacggagaucccugggcggacuccgaugcccuggcuuucucuggcgugauggugagcaugaaggaaccugggugguacuccuuuggcuucgagaucaaggacaaaaagugcgaugucccguguauuggaaucgaaaugguucacgacggcgggaaagagacauggcauagcgccgccaccgcuauuuauugccucaugggaucuggccagcugcuuugggauacagugacggggguggacauggcccuguga

SEQ ID NO: 213104 - RNA, 1401 nt, Artificial Sequence
  derived and/or modified sequence opt5 from neuraminidase__InfluenzaB__AHL92908
augcugcccagcaccauccagacacucacgcuguuccuuacccugggcggggugcuccugucccuuuacgucucugccagccuguccuaucuccuguacucugacauucugcucaaguuuagccaaacagagaucaccgcuccuauuaugccgcuggauugcgccaacgcguccaauguucaggcugugaacagaucugccacaaaaggagugacccuucugcuccccgaaccugaguggacauauccccggcugagcuguccuggcuccaccuuccagaaggcccuucugaucagcccccaccgcuuuggggaaacgaaaggaaauucugcuccucucauuaucagagagccguucaucgccugcggccccaaggaauguaaacauuuugcucugacccacuacgccgcgcagccugggggauauuacaacggcacacgggaggaccgcaauaagcugagacaucucauuuccgucaagcugggcaaaauccccaccguggagaacagcauuuuccacauggccgcuuggucuggguccgccugccaugauggaaaggaauggacauauaucggcguugacgggccugauagcaaugcccuucugaaaauuaaguacggagaggcuuacaccgacacguaucacucuuacgcgaaaaacauccuccggacacaagaauccgccuguaauugcauuggcggggauuguuaucugaugaucaccgacggacccgcuagcggcaucuccgagugccgcuuucuuaagauuagagagggccggaucauuaaggaaaucuucccgacagggcgcgugaaacacaccgaggaauguaccugcggauuugccucuaacaagacaauugagugugcuugcagagauaauagcuacacggccaaacggccuuucgucaagcugaacguggaaaccgacacagccgagauccgccucaugugcaccgagacauaucuggauacccccagaccuaaugacggcuccaucacggggcccugugaaagcaacggagauaaaggcucugggggaauuaagggcggcuuuguucaucagcggauggcuuccaaaaucgggcgcugguacagcagaacaaugucuaagaccaagcggaugggaaugggccuguaugugaaauacgacggggaccccuggaccgauagcgaggcgcucgcccuguccggagucauggugucuauggaggaaccuggcugguacagcuucggguuugaaauuaaggacaaaaagugcgaugugccguguaucggcauugagaugguccacgacggaggcaaaacaaccuggcauuccgcugccacagccguuuauugccuuauggggagcggacagcugcucugggauacgaucaccggcguggacauggcucuguga

SEQ ID NO: 213105 - RNA, 1401 nt, Artificial Sequence
  derived and/or modified sequence opt5 from neuraminidase__InfluenzaB__AHL92919
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggaucgacggacccgauaacaaugcucugcuuaagauuaaauacggcgaggccuacacggacacauaucacucuuacgcgaacaauauccugcggacccaggaguccgccuguaacugcauugggggaaauuguuaucucaugaucacagauggcagcgcuuccggcguuucugaaugccgcuuucugaagaucagagaggggcggauuaucaaagagauuuucccgaccggacgcgugaagcacaccgaagaguguacaugcggcuuugccagcaacaagacgaucgaaugugcuugcagagacaauuccuacaccgccaaacggccuuucgucaaacuuaacguggagacagauaccgccgaaauucgccugaugugcacagacaccuaucucgauacgcccagaccugacgaugggagcaucacaggacccugugagucuaacggcgacaagggguccggaggcaucaagggcggguuuguucaucaacggauggcuagcaaaauuggacgcugguacucuagaaccaugagcaagaccgagcggaugggcauggggcuguaugugaaauacgacggagaucccugggcggacuccgaugcccuggcuuucucuggcgucauggugagcaugaaggaaccugggugguacuccuuuggcuucgagaucaaggacaaaaagugcgaugugccguguauuggaaucgaaaugguccacgacggcgggaaagagacauggcauagcgccgccaccgcuauuuauugccucaugggaucuggccagcugcuuugggauacaguuacggggguggacauggcccuguga

SEQ ID NO: 213106 - RNA, 1401 nt, Artificial Sequence
  derived and/or modified sequence opt5 from neuraminidase__InfluenzaB__AHL92930
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacgacgcucugcuuaagaucaaauacggcgaggccuacacggauacauaucacucuuacgcgaauaacauucugcggacccaggaguccgccuguaauugcaucgggggaaacuguuaucucaugauuacagacggcagcgcuuccggcgugucugaaugccgcuuucugaagaucagagaggggcggaucauuaaagagaucuucccgaccggacgcgucaagcacaccgaagaguguacaugcggcuuugccagcaauaagacgauugaaugugcuugcagagauaacuccuacaccgccaaacggccuuucgugaaacuugacguugagacagauaccgccgaaauccgccugaugugcacagacaccuaucucgauacgcccagaccugacgacgggagcauuacaggacccugugagucuaauggcgauaagggguccggaggcaucaagggcggguuugugcaucaacggauggcuagcaaaaucggacgcugguacucuagaaccaugagcaagaccgagcggaugggcauggggcuguaugucaaauacgacggagaucccugggcggacuccgaugcccuggcuuucucuggcgugauggugagcaugaaggaaccugggugguacuccuuuggcuucgagauuaaggacaaaaagugcgaugucccguguaucggaauugaaaugguucacgacggcgggaaagagacauggcauagcgccgccaccgcuaucuauugccucaugggaucuggccagcugcuuugggauacagugacggggguggacauggcccuguga

SEQ ID NO: 213107 - RNA, 1401 nt, Artificial Sequence; identical to SEQ ID NO: 211651
  derived and/or modified sequence opt5 from neuraminidase__InfluenzaB__AHL92941

SEQ ID NO: 213108 - RNA, 1401 nt, Artificial Sequence; identical to SEQ ID NO: 211659
  derived and/or modified sequence opt5 from neuraminidase__InfluenzaB__AHL92952

SEQ ID NO: 213109 - RNA, 1401 nt, Artificial Sequence; identical to SEQ ID NO: 211659
  derived and/or modified sequence opt5 from neuraminidase__InfluenzaB__AHL92963

SEQ ID NO: 213110 - RNA, 1401 nt, Artificial Sequence
  derived and/or modified sequence opt5 from neuraminidase__InfluenzaB__AHL92974
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucacgcugugaacagaagcgccaccaaaggagugacacugcuucugccugaacccgaguggaccuauccucggcucuccugucccggcagcacguuccaaaaggcccugcuuauuucuccucaucgcuuuggggaaaccaaaggaaauuccgcuccgcugaucauuagagagcccuucaucgccugcggcccuaacgaauguaagcacuuugcucucacacauuacgccgcgcagcccgggggauauuacaauggcacccggggcgaccgcaacaaacugagacaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaagaucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggaucauuaaagagaucuucccgaccggacgcgucaagcauaccgaagaguguacaugcggcuuugccagcaacaagacgauugaaugugcuugcagagacaauuccuacaccgccaaacggccuuucgugaaacuuaacguugagacagauaccgccgaaauccgccugaugugcacagacaccuaucucgauacgcccagaccugacgaugggagcauuacaggacccugugagucuaacggcgacaagggguccggaggcaucaagggcggguuugugcaccagcggauggcuagcaaaaucggacgcugguacucuagaaccaugagcaagaccgagcggaugggcauggggcuguaugucaaauacaauggagaccccugggcggauuccgacgcccuggcuuucucuggcgugauggugagcaugaaggaaccugggugguacuccuuuggcuucgagauuaaggauaaaaagugcgacgucccguguaucggaauugaaaugguucaugauggcgggaaagagacauggcacagcgccgccaccgcuaucuauugccucaugggaucuggccaacugcuuugggacacagugacggggguggauauggcccuguga

SEQ ID NO: 213111 - RNA, 1401 nt, Artificial Sequence; identical to SEQ ID NO: 211659
  derived and/or modified sequence opt5 from neuraminidase__InfluenzaB__AHL92985

SEQ ID NO: 213112 - RNA, 1401 nt, Artificial Sequence; identical to SEQ ID NO: 211659
  derived and/or modified sequence opt5 from neuraminidase__InfluenzaB__AHL92996

SEQ ID NO: 213113 - RNA, 1401 nt, Artificial Sequence; identical to SEQ ID NO: 213032
  derived and/or modified sequence opt5 from neuraminidase__InfluenzaB__AHL93008

SEQ ID NO: 213114 - RNA, 1401 nt, Artificial Sequence; identical to SEQ ID NO: 213041
  derived and/or modified sequence opt5 from neuraminidase__InfluenzaB__AHL93019

SEQ ID NO: 213115 - RNA, 1401 nt, Artificial Sequence; identical to SEQ ID NO: 213041
  derived and/or modified sequence opt5 from neuraminidase__InfluenzaB__AHL93030

SEQ ID NO: 213116 - RNA, 1401 nt, Artificial Sequence; identical to SEQ ID NO: 213055
  derived and/or modified sequence opt5 from neuraminidase__InfluenzaB__AHL93041

SEQ ID NO: 213117 - RNA, 1401 nt, Artificial Sequence; identical to SEQ ID NO: 213055
  derived and/or modified sequence opt5 from neuraminidase__InfluenzaB__AHL93052

SEQ ID NO: 213118 - RNA, 1401 nt, Artificial Sequence; identical to SEQ ID NO: 211841
  derived and/or modified sequence opt5 from neuraminidase__InfluenzaB__AHL93063

SEQ ID NO: 213119 - RNA, 1401 nt, Artificial Sequence; identical to SEQ ID NO: 211841
  derived and/or modified sequence opt5 from neuraminidase__InfluenzaB__AHL93074

SEQ ID NO: 213120 - RNA, 1401 nt, Artificial Sequence; identical to SEQ ID NO: 211841
  derived and/or modified sequence opt5 from neuraminidase__InfluenzaB__AHL93085

SEQ ID NO: 213121 - RNA, 1401 nt, Artificial Sequence; identical to SEQ ID NO: 213098
  derived and/or modified sequence opt5 from neuraminidase__InfluenzaB__AHL93096

SEQ ID NO: 213122 - RNA, 1401 nt, Artificial Sequence; identical to SEQ ID NO: 211841
  derived and/or modified sequence opt5 from neuraminidase__InfluenzaB__AHL93107

SEQ ID NO: 213123 - RNA, 1401 nt, Artificial Sequence; identical to SEQ ID NO: 211841
  derived and/or modified sequence opt5 from neuraminidase__InfluenzaB__AHL93118

SEQ ID NO: 213124 - RNA, 1401 nt, Artificial Sequence; identical to SEQ ID NO: 211812
  derived and/or modified sequence opt5 from neuraminidase__InfluenzaB__AHL93129

SEQ ID NO: 213125 - RNA, 1401 nt, Artificial Sequence; identical to SEQ ID NO: 211841
  derived and/or modified sequence opt5 from neuraminidase__InfluenzaB__AHL93140

SEQ ID NO: 213126 - RNA, 1401 nt, Artificial Sequence; identical to SEQ ID NO: 211812
  derived and/or modified sequence opt5 from neuraminidase__InfluenzaB__AHL93151

SEQ ID NO: 213127 - RNA, 1401 nt, Artificial Sequence; identical to SEQ ID NO: 211841
  derived and/or modified sequence opt5 from neuraminidase__InfluenzaB__AHL93162

SEQ ID NO: 213128 - RNA, 1401 nt, Artificial Sequence; identical to SEQ ID NO: 211841
  derived and/or modified sequence opt5 from neuraminidase__InfluenzaB__AHL93173

SEQ ID NO: 213129 - RNA, 1401 nt, Artificial Sequence; identical to SEQ ID NO: 211812
  derived and/or modified sequence opt5 from neuraminidase__InfluenzaB__AHL93184

SEQ ID NO: 213130 - RNA, 1401 nt, Artificial Sequence; identical to SEQ ID NO: 211841
  derived and/or modified sequence opt5 from neuraminidase__InfluenzaB__AHL93195

SEQ ID NO: 213131 - RNA, 1401 nt, Artificial Sequence; identical to SEQ ID NO: 211841
  derived and/or modified sequence opt5 from neuraminidase__InfluenzaB__AHL93206

SEQ ID NO: 213132 - RNA, 1401 nt, Artificial Sequence; identical to SEQ ID NO: 211985
  derived and/or modified sequence opt5 from neuraminidase__InfluenzaB__AHL93217

SEQ ID NO: 213133 - RNA, 1401 nt, Artificial Sequence; identical to SEQ ID NO: 211985
  derived and/or modified sequence opt5 from neuraminidase__InfluenzaB__AHL93228

SEQ ID NO: 213134 - RNA, 1401 nt, Artificial Sequence
  derived and/or modified sequence opt5 from neuraminidase__InfluenzaB__AHL93239
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuuaucgccugcggcccuaacgaauguaagcauuucgcucugacacacuacgccgcgcagcccgggggauauuacaauggcacccggggcgaccgcaacaaacucagacaucugaucagcgucaagcuggggaagauuccuacaguggaaaauucuaucuuucacauggccgcuugguccggaagcgccugccaugauggcaaagaguggaccuauauugggguugacggacccgauaacaaugcucuccugaaggugaaauacggcgaggccuacacggacacauaucacucuuacgcgaacaagauccuucggacccaggaguccgccuguaauugcauugggggaaacuguuaucugaugaucacagauggcagcgcuuccggcgucucugaaugccgcuuccucaaaauuagagaggggcggaucaucaaggagauuuuuccgaccggacgcgugaagcacaccgaagaguguacaugcggcuucgccagcaauaaaacgaucgaaugugcuugcagagacaacuccuacaccgccaagcggccuuuuguuaaacugaauguggagacagauaccgccgaaauucgccuuaugugcacagacaccuaucuggauacgcccagaccugacgaugggagcaucacaggacccugugagucuaacggcgacaagggguccggaggcauuaaaggcggguucguccaucaacggauggagagcaagaucggacgcugguacucuagaaccaugagcaaaaccgaacggaugggcauggggcucuaugugaaguacgacggagaucccugggcugacuccgaugcgcuggccuuuucuggcgugauggucagcaugaaggagccugggugguacuccuucggcuucgaaaucaaagacaagaaaugcgauguuccguguauuggaaucgagauggugcacgacggcgggaaggaaacauggcauagcgcugccaccgccauuuauugccugaugggaucuggccagcuccugugggauacagugacgggggucgacauggcucuuuga

SEQ ID NO: 213135 - RNA, 1401 nt, Artificial Sequence
  derived and/or modified sequence opt5 from neuraminidase__InfluenzaB__AHL93250
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaaggguccggaggcaucaagggcggguucgugcaccagcggauggcuagcaaaaucggacgcugguacucuagaacaaugagcaagaccgagcggaugggcauggggcucuaugucaaauacgacggagaucccuggaccgacuccgaugcgcuggccuuuagaggcgugauggugucuaugaaggaaccugggugguacagcuucggcuucgagauuaaggacaaaaagugcgaugucccguguaucggaauugaaaugguucaugacggcgggaaagagacauggcacuccgcugccaccgccaucuauugccugaugggaagcggccaacuccugugggauacagugacggggguggacauggcucuuuga

SEQ ID NO: 213136 - RNA, 1401 nt, Artificial Sequence; identical to SEQ ID NO: 211985
  derived and/or modified sequence opt5 from neuraminidase__InfluenzaB__AHL93261

SEQ ID NO: 213137 - RNA, 1401 nt, Artificial Sequence; identical to SEQ ID NO: 211985
  derived and/or modified sequence opt5 from neuraminidase__InfluenzaB__AHL93272

SEQ ID NO: 213138 - RNA, 1401 nt, Artificial Sequence; identical to SEQ ID NO: 211985
  derived and/or modified sequence opt5 from neuraminidase__InfluenzaB__AHL93283

SEQ ID NO: 213139 - RNA, 1401 nt, Artificial Sequence; identical to SEQ ID NO: 211985
  derived and/or modified sequence opt5 from neuraminidase__InfluenzaB__AHL93294

SEQ ID NO: 213140 - RNA, 1401 nt, Artificial Sequence
  derived and/or modified sequence opt5 from neuraminidase__InfluenzaB__AHL93305
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucgucgccugcggcccuaacgaauguaagcauuuugcucucacacacuacgccgcgcagcccgggggauauuacaauggcacccggggcgaccgcaacaaacugagacaucugaucagcgugaagcucgggaagaucccuacaguugaaaauucuauuuuccacauggccgcuugguccggaagcgccugccaugauggcaaagaguggaccuauaucgggguggacggacccgauaacaaugcucugcuuaaggucaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaaauccgccugaugugcacagacaccuaucucgauacgcccagaccuaacgacgggagcauuacaggacccugugagucuaacggcgauaagggguccggaggcaucaaaggcggguuugugcaucaacggauggagagcaagauuggacgcugguacucuagaaccaugagcaaaaccgaacggaugggcauggggcuguaugugaaguacgacggagaccccugggcugauuccgacgcgcuggccuucucuggcgucaugguuagcaugaaggagccugggugguacuccuuuggcuucgaaaucaaagauaagaaaugcgacgugccguguaucggaauugagauggugcacgauggcgggaaggaaacauggcauagcgcugccaccgccaucuauugccucaugggaucuggccagcugcuuugggacacagucacggggguggauauggcucuguga

SEQ ID NO: 213141 - RNA, 1401 nt, Artificial Sequence; identical to SEQ ID NO: 211985
  derived and/or modified sequence opt5 from neuraminidase__InfluenzaB__AHL93316

SEQ ID NO: 213142 - RNA, 1401 nt, Artificial Sequence
  derived and/or modified sequence opt5 from neuraminidase__InfluenzaB__AHL93338
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagaugccgcugaaauucgccugaugugcaccgacacauaucucgauacccccagaccuaacgacgggagcaucacgggacccugugagucuaacggcgauaagggguccggaggcauuaaaggcggguuuguccaucaacggauggagagcaagaucggacgcugguacucuagaacaaugagcaaaaccgaacggaugggcauggggcuguaugugaaguacgacggagaccccugggcggauuccgacgcccuggcuuucucuggcgugauggucagcaugaaggagccugggugguacuccuuuggcuucgaaaucaaagauaagaaaugcgacguuccguguauuggaaucgagauggugcacgauggcgggaaggaaaccuggcauagcgccgccacagcuauuuauugccucaugggaucuggccagcugcuuugggacaccgugacaggggucgauauggcccuguga

SEQ ID NO: 213143 - RNA, 1401 nt, Artificial Sequence
  derived and/or modified sequence opt5 from neuraminidase__InfluenzaB__AHL93349
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucagggcagcacguuccagaaggcccugcuuauuucuccccaccgcuuuggggaaaccaaaggaaauuccgcuccucugaucauuagagagccguucaucgccugcggccccaacgaauguaagcauuuugcucucacacacuacgccgcgcagccugggggauauuacaauggcacccggggcgaccgcaacaaacugagacaucugaucagcgucaagcucgggaagauucccacaguggaaaauucuaucuuccacauggccgcuugguccggaagcgccugccaugauggcaaagaguggaccuauauugggguugacggaccugauaacaaugcucugcuuaaggugaaauacggcgaggccuacacggacacauaucacucuuacgcgaacaagauccugcggacccaagaguccgccuguaauugcauugggggaaacuguuaucucaugaucacagauggcagcgcuuccggcgucucugaaugccgcuuucugaaaauuagagaggggcggaucaucaaggagauuuuccccaccggacgcgugaagcacaccgaagaguguacaugcggcuuugccagcaauaaaacgaucgaaugugcuugcagagacaacuccuacaccgccaagcggccguucguuaaacuuaauguggagacagauaccgccgaaauucgccugaugugcacagacaccuaucucgauacgccuagacccaacgacgggagcaucacaggaccuugugagucuaacggcgauaagggguccggaggcauuaaaggcggguuuguccaucagcggauggagagcaagaucggacgcugguacucuagaaccaugagcaaaaccgaacggaugggcauggagcuguaugugaaguacgacggggaccccugggcugauuccgacgcgcuggccuucucuggagugauggucagcaugaaggaacccggcugguacuccuuuggguucgagaucaaagauaagaaaugcgacguuccuuguauuggcaucgaaauggugcacgauggaggcaaggagacauggcauagcgcugccaccgccauuuauugccucauggggucuggacagcugcuuugggacacagugacgggcgucaauauggcucuguga

SEQ ID NO: 213144 - RNA, 1401 nt, Artificial Sequence; identical to SEQ ID NO: 211985
  derived and/or modified sequence opt5 from neuraminidase__InfluenzaB__AHL93371

SEQ ID NO: 213145 - RNA, 1401 nt, Artificial Sequence
  derived and/or modified sequence opt5 from neuraminidase__InfluenzaB__AHL93382
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggagcuguaugugaaguacgacggggaccccugggcugauuccgacgcgcuggccuucucuggagugauggucagcaugaaggaaccuggcugguacuccuuuggguucgagaucaaagauaagaaaugcgacguuccguguauuggcaucgaaauggugcacgauggaggcaaggagacauggcauagcgcugccaccgccauuuauugccucauggggucuggacagcugcuuugggacacagugacgggcgucaauauggcucuguga

SEQ ID NO: 213146 - RNA, 1401 nt, Artificial Sequence; identical to SEQ ID NO: 211985
  derived and/or modified sequence opt5 from neuraminidase__InfluenzaB__AHL93393

SEQ ID NO: 213147 - RNA, 1401 nt, Artificial Sequence; identical to SEQ ID NO: 211985
  derived and/or modified sequence opt5 from neuraminidase__InfluenzaB__AHL93404

SEQ ID NO: 213148 - RNA, 1401 nt, Artificial Sequence; identical to SEQ ID NO: 211985
  derived and/or modified sequence opt5 from neuraminidase__InfluenzaB__AHL93415

SEQ ID NO: 213149 - RNA, 1401 nt, Artificial Sequence; identical to SEQ ID NO: 211985
  derived and/or modified sequence opt5 from neuraminidase__InfluenzaB__AHL93426

SEQ ID NO: 213150 - RNA, 1401 nt, Artificial Sequence; identical to SEQ ID NO: 211985
  derived and/or modified sequence opt5 from neuraminidase__InfluenzaB__AHL93437

SEQ ID NO: 213151 - RNA, 1401 nt, Artificial Sequence; identical to SEQ ID NO: 213145
  derived and/or modified sequence opt5 from neuraminidase__InfluenzaB__AHL93448

SEQ ID NO: 213152 - RNA, 1404 nt, Artificial Sequence
  derived and/or modified sequence opt5 from neuraminidase__InfluenzaB__AHL93459
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugcucccugaacccgaguggaccuauccucggcuguccugucccggcagcacguuccagaaggcccuucugauuucuccucaccgcuuuggggaaaccaaaggaaauuccgcuccgcucaucauuagagagcccuucaucgccugcggcccuaacgaauguaagcauuuugcucugacacacuacgccgcgcagcccgggggauauuacaauggcacccggggcgaccgcaacaaacugagacaucucaucagcgucaagcuggggaagauuccuacaguggaaaauucuaucuuccacauggccgcuugguccggaagcgccugccaugauggcaaagaguggaccuauauugggguugacggacccgauaacaaugcccuucugaaggugaaauacggcgaggcuuacacggacacauaucacucuuacgcgaacaagauccuccggacccaggaguccgccuguaauugcauugggggaaacuguuaucugaugaucacagauggcagcgcuuccggcgucucugaaugccgcuuucuuaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacugaauguggagacagauaccgccgaaauucgccucaugugcacagacaccuaucuggauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcucgccuucucuggcgugauggucagcaugaaggagccugggugguacuccuuuggcuucgaaaucaaagauaagaaaugcgacguuccguguauuggaaucgagauggugcacgauggcgggaaggaaacauggcauagcgcugccaccgccauuuauugccugaugggaucuggccagcuucugugggacacagugacgggggucgauauggcucucuga

SEQ ID NO: 213153 - RNA, 1401 nt, Artificial Sequence
  derived and/or modified sequence opt5 from neuraminidase__InfluenzaB__AHL93470
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcugacauucucuggcgugauggucagcaugaaggagccugggugguacuccuuuggcuucgaaaucaaagauaagaaaugcgacguuccguguauuggaaucgagauggugcacgauggcgggaaggaaaccuggcauagcgccgcuacagccauuuauugccucaugggaucuggccagcugcuuugggacacggugaccggggucgauauggcccuguga

SEQ ID NO: 213154 - RNA, 1401 nt, Artificial Sequence; identical to SEQ ID NO: 211922
  derived and/or modified sequence opt5 from neuraminidase__InfluenzaB__AHL93481

SEQ ID NO: 213155 - RNA, 1401 nt, Artificial Sequence; identical to SEQ ID NO: 211980
  derived and/or modified sequence opt5 from neuraminidase__InfluenzaB__AHL93492

SEQ ID NO: 213156 - RNA, 1401 nt, Artificial Sequence; identical to SEQ ID NO: 211841
  derived and/or modified sequence opt5 from neuraminidase__InfluenzaB__AHL93503

SEQ ID NO: 213157 - RNA, 1401 nt, Artificial Sequence
  derived and/or modified sequence opt5 from neuraminidase__InfluenzaB__AHL93514
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcauuaagcucgggaagaucccuacagucgaaaauucuauuuuccacauggccgcuugguccggaagcgccugccaugauggcaaagaguggaccuauaucgggguggacggacccgauaacaaugcucugcuuaagguuaaauacggcgaggccuacacggacacauaucacucuuacgcgaacaagauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcgucaagcacaccgaagaguguacaugcggcuuugccagcaauaaaacgauugaaugugcuugcagagacaacuccuacaccgccaagcggccuuucgugaaacuuaauguugagacagauaccgccgaaauccgccugaugugcacagacaccuaucucgauacgcccagaccugacgaugggagcauuacaggaucuugugaguccaacggcgacaaggggagcggaggcaucaaaggcggguuugugcaucaacggauggagucuaagaucggacgcugguacagcagaaccauguccaaaaccgaacggaugggcauggggcuguaugucaaguacgacggagaucccugggcugacucugaugcgcugacauucagcggcgugaugguguccaugaaggagcccgggugguacagcuuuggcuucgaaauuaaagacaagaaaugcgaugucccuuguaucggaauugagaugguucacgacggcgggaaggaaaccuggcauucugccgcuacagccaucuauugccucaugggauccggccagcugcuuugggauacggugaccgggguggacauggcccuguga

SEQ ID NO: 213158 - RNA, 1401 nt, Artificial Sequence; identical to SEQ ID NO: 211841
  derived and/or modified sequence opt5 from neuraminidase__InfluenzaB__AHL93525

SEQ ID NO: 213159 - RNA, 1401 nt, Artificial Sequence; identical to SEQ ID NO: 211980
  derived and/or modified sequence opt5 from neuraminidase__InfluenzaB__AHL93536

SEQ ID NO: 213160 - RNA, 1401 nt, Artificial Sequence
  derived and/or modified sequence opt5 from neuraminidase__InfluenzaB__AHL93558
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcgugaagcacaccgaagaguguaccugcggcuuugcuagcaauaaaacaaucgaaugugccugcagagacaacuccuacacggccaagcggccuuucguuaaacuuaauguggagaccgauacagcugaaauucgccugaugugcaccgacacauaucucgauacccccagaccuaacgacgggagcaucacgggacccugugagucugauggcgacaagggguccggaggcauuaaaggcggguuuauccaucaacggauggagagcaagaucggacgcugguacucuagaacaaugagcaaaaccgaacggaugggcauggggcuguaugucaaguacgacggagaucccugggcggacuccgaugcccuggcuuucucuggcgugauggugagcaugaaggagccugggugguacuccuuuggcuucgaaauuaaagacaagaaaugcgaugucccguguaucggaauugagaugguucacgacggcgggaaggaaaccuggcauagcgccgccacagcuaucuauugccucaugggaucuggccagcugcuuugggauaccgugacagggguggacauggcccuguga

SEQ ID NO: 213161 - RNA, 1401 nt, Artificial Sequence
  derived and/or modified sequence opt5 from neuraminidase__InfluenzaB__AHL93569
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccugggcugacuccgaugcgcugacauucucuggcgugauggucagcaugaaggagccugggugguacuccuuuggcuucgaaaucaaagacaagaaaugcgauguuccguguauuggaaucgagauggugcacgacggcgggaaggaaaccuggcauagcgccgcuacagccauuuauugccucaugggaucuggccagcugcuuugggauacggugaccggggucgacauggcccuguga

SEQ ID NO: 213162 - RNA, 1401 nt, Artificial Sequence; identical to SEQ ID NO: 211980
  derived and/or modified sequence opt5 from neuraminidase__InfluenzaB__AHL93580

SEQ ID NO: 213163 - RNA, 1401 nt, Artificial Sequence; identical to SEQ ID NO: 211980
  derived and/or modified sequence opt5 from neuraminidase__InfluenzaB__AHL93591

SEQ ID NO: 213164 - RNA, 1401 nt, Artificial Sequence
  derived and/or modified sequence opt5 from neuraminidase__InfluenzaB__AHL93613
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucauggucacagauggcagcgcuuccggcgugucugaaugccgcuuucugaaaaucagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggagagcaagauuggacgcugguacucuagaaccaugagcaaaaccgaacggaugggcauggggcuguaugugaaguacgacggagaucccugggcugacuccgaugcgcuggucuucucuggcguuauggugagcaugaaggagccugggugguacuccuuuggcuucgaaaucaaagacaagaaaugcgaugugccguguaucggaauugagaugguccacgacggcgggaaggaaacauggcauagcgccgcuaccgccaucuauugccucaugggaucuggccagcugcuuugggauacagugacggggguugacauggcccuguga

SEQ ID NO: 213165 - RNA, 1401 nt, Artificial Sequence; identical to SEQ ID NO: 211980
  derived and/or modified sequence opt5 from neuraminidase__InfluenzaB__AHL93624

SEQ ID NO: 213166 - RNA, 1401 nt, Artificial Sequence; identical to SEQ ID NO: 213164
  derived and/or modified sequence opt5 from neuraminidase__InfluenzaB__AHL93635

SEQ ID NO: 213167 - RNA, 1401 nt, Artificial Sequence; identical to SEQ ID NO: 213164
  derived and/or modified sequence opt5 from neuraminidase__InfluenzaB__AHL93646

SEQ ID NO: 213168 - RNA, 1401 nt, Artificial Sequence; identical to SEQ ID NO: 211841
  derived and/or modified sequence opt5 from neuraminidase__InfluenzaB__AHL93657

SEQ ID NO: 213169 - RNA, 1401 nt, Artificial Sequence; identical to SEQ ID NO: 211980
  derived and/or modified sequence opt5 from neuraminidase__InfluenzaB__AHL93668

SEQ ID NO: 213170 - RNA, 1401 nt, Artificial Sequence
  derived and/or modified sequence opt5 from neuraminidase__InfluenzaB__AHL93679
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagaaggcccugcuuauuucuccccaccgcuucggggaaaccaaaggaaauuccgcuccucugaucauuagagagccguuuaucgccugcggccccaacgaauguaagcauuucgcucucacacacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacggauacauaucacucuuacgcgaauaagauccugcggacccaggaguccgccuguaacugcauugggggaaauuguuaucucaugaucacagacggcagcgcuuccggcgucucugaaugccgcuuccugaaaauuagagaggggcggaucaucaaggagauucuucccaccggacgcgugaagcacaccgaagaguguacaugcggcuuugccagcaacaaaacgaucgaaugugcuugcagagauaauuccuacaccgccaagcggccguucguuaaacugaacguggagacagacaccgccgaaauucgccucaugugcacagauaccuaucuggacacgccuagacccgaugacgggagcaucacaggaccuugugagucuaauggcgacaagggguccggaggcauuaaaggcggguuuguccaucaacggauggagagcaagaucggacgcugguacucuagaaccaugagcaaaaccgaacggaugggcauggggcuguaugugaaguacgauggagaccccugggcugauuccgacgcgcucgccuucucuggcgugauggucagcaugaaggagcccgggugguacuccuuuggcuucgaaaucaaagauaagaaaugcgacguuccuuguauuggaaucgagauggugcacgauggcgggaaggaaacauggcauagcgcugccaccgccauuuauugccugaugggaucuggccagcuucugugggacacagugacgggggucgauauggcucucuga

SEQ ID NO: 213171 - RNA, 1401 nt, Artificial Sequence; identical to SEQ ID NO: 213164
  derived and/or modified sequence opt5 from neuraminidase__InfluenzaB__AHL93690

SEQ ID NO: 213172 - RNA, 1401 nt, Artificial Sequence; identical to SEQ ID NO: 213164
  derived and/or modified sequence opt5 from neuraminidase__InfluenzaB__AHL93701

SEQ ID NO: 213173 - RNA, 1401 nt, Artificial Sequence; identical to SEQ ID NO: 213164
  derived and/or modified sequence opt5 from neuraminidase__InfluenzaB__AHL93712

SEQ ID NO: 213174 - RNA, 1401 nt, Artificial Sequence
  derived and/or modified sequence opt5 from neuraminidase__InfluenzaB__AHL93723
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcacgacaggacccugugagucuaacggcgacaaaggguccggaggcauuaagggcggguucgugcaccagcggauggcuagcaaaaucggacgcugguacucuagaaccaugagcaagaccgagcggaaaggcauggggcucuaugucaaguacgacggagaucccuggacagacuccgaugcgcuggccuuuagaggcgugauggugucuaugaaggaaccugggugguacagcuucggcuucgagaucaaagacaagaaaugcgaugucccguguauuggaaucgaaaugguucaugacggcgggaaggagaccuggcacuccgcugccacagccauuuauugccugaugggaagcggccaacuccugugggauacggugaccgggguggacauggcucuuuga

SEQ ID NO: 213175 - RNA, 1401 nt, Artificial Sequence; identical to SEQ ID NO: 211980
  derived and/or modified sequence opt5 from neuraminidase__InfluenzaB__AHL93734

SEQ ID NO: 213176 - RNA, 1401 nt, Artificial Sequence
  derived and/or modified sequence opt5 from neuraminidase__InfluenzaB__AHL93745
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaaugugcuucggacacaggaguccgccuguaacugcauugggggaaauuguuaucugaugaucaccgauggcagcgcuuccggcgucucugaaugccgcuuccucaagauuagagaggggcggaucaucaaagagauuuuuccgacaggacgcgugaagcauaccgaagaguguaccugcggcuucgccagcaacaagacaaucgaaugugcuugcagagacaauuccuacacggccaaacggccuuuuguuaagcugaacguggagaccgauacagccgaaauucgccuuaugugcaccgacacauaucuggauacccccagaccugacgaugggagcaucacgggacccugugagucuaacggcgacaaaggguccggaggcauuaagggcggguucguccaccagcggauggcuagcaaaaucggacgcugguacucuagaacaaugagcaagaccgagcggaaaggcauggggcucuaugugaaguacgacggagaucccuggaccgacuccgaugcgcuggccuuuagaggcgugauggucucuaugaaggaaccugggugguacagcuucggcuucgagaucaaagacaagaaaugcgauguuccguguauuggaaucgaaauggugcaugacggcgggaaggagacauggcacuccgcugccaccgccauuuauugccugaugggaagcggccaacuccugugggauacagugacgggggucgacauggcucuuuga

SEQ ID NO: 213177 - RNA, 1401 nt, Artificial Sequence; identical to SEQ ID NO: 212143
  derived and/or modified sequence opt5 from neuraminidase__InfluenzaB__AHL93756

SEQ ID NO: 213178 - RNA, 1401 nt, Artificial Sequence; identical to SEQ ID NO: 213164
  derived and/or modified sequence opt5 from neuraminidase__InfluenzaB__AHL93767

SEQ ID NO: 213179 - RNA, 1401 nt, Artificial Sequence
  derived and/or modified sequence opt5 from neuraminidase__InfluenzaB__AHL93778
augcugcccagcaccauccagacacucauucuguuccuuacguccggcggggugcugcucucucuguacgucagcgcccuucuguccuaucuccuguacucugacauccugcucaaguuuagcccuaccgagauuacagcuccgaccaugucccuggauugcgccaacgcgucuaauguucaagcugugaacagaagcgccacaaaaggagugaccuuccuucugcccgaaccugaguggacauauccccggcucuccuguccuggcagcaucuuucagaaggcccugcuuauuucuccccaccgcuucggggaaaccaaaggaaauuccgcuccucugaucaucagagagccguuuauugccugcggccccaacgaauguaagcauuucgcucucacgcacuacgccgcgcagccugggggauauuacaauggcacccggggcgaccgcaacaaacugagacaucugaucagcgucaagcucgggaagauucccacaguggaaaauucuaucuuucacauggccgcuugguccggaagcgccugccaugauggcaaagaguggaccuauauugggguugacggaccugauaacgacgcucugcuuaaggugaaauacggcgaggccuacacagauaccuaucacucuuacgcgaauaagauccugcggacgcaggaguccgccuguaacugcauugggggaaauuguuaucucaugaucacagacggcagcgcuuccggcgucucugaaugccgcuuccugaaaaucagagaggggcggauuaucaaggagauuuuucccaccggacgcgugaagcacacagaagaguguaccugcggcuucgccagcaacaaaaccaucgaaugugcuugcagagauaauuccuacacagccaagcggccguuuguuaaacuuaacguggagacggacaccgccgaaauucgccugaugugcacagauaccuaucucgacacaccuagacccgaugacgggagcaucaccggaccuugugagucuaauggcgacaagggguccggaggcaucaaaggcggguucguccaucaacggauggagagcaagauuggacgcugguacucuagaacgaugagcaaaacagaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaaccuggcauagcgcugccaccgccauuuauugccucaugggaucuggccagcugcuuugggacacagugaccggggucgauauggcucuguga

SEQ ID NO: 213180 - RNA, 1401 nt, Artificial Sequence
  derived and/or modified sequence opt5 from neuraminidase__InfluenzaB__AHL93789
augcugcccagcaccauccagacacucacgcuguuccuuaccuccggcggggugcugcucucucuguacgucagcgccucccuuucuuaucugcucuacagcgacauucugcugaaguuuuccccuacaggaaucaccgcuccgacaaugccccucgauugcgccaacgcgucuaauguucaagcugugaacagaagcgccaccaaaggcgugacacugcuucugccugagcccgaauggaccuauccucggcucuccugucccgggagcacguuccagaaggcccugcuuauuucuccucaccgcuuuggagagaccaaaggcaauuccgcuccgcugaucauuagagaacccuucaucgccugcgggccuaacgaguguaagcauuuugcucucacacacuacgccgcgcagcccggaggcuauuacaauggcacccgcggggaccggaacaaacugagacaucugaucagcgucaagcucggaaagauuccuacaguggaaaauucuaucuuccacauggccgcuugguccggcagcgccugccaugaugggaaagaguggaccuauauuggaguugacggccccgauaacaaugcucugcuuaaggugaaauacggggaggccuacacggacacauaucacucuuacgcgaacaagauccugcggacccaggaauccgccuguaauugcauuggaggcaacuguuaucucauggucacagauggcagcgcuuccggggugucugagugccgcuuucugaaaaucagagaaggacggauuaucaaggagaucuucccgaccggccgcguuaagcacaccgaggaauguacaugcggguuugccagcaauaaaacgauugagugugcuugcagagacaacuccuacaccgccaagcggccuuucgugaaacuuaaugucgaaacagauaccgccgagauccgccugaugugcacagacaccuaucucgauacgcccagaccugacgauggaagcauuacaggccccugugaaucuaacggggacaagggauccggcggcaucaaagggggauuugugcaucaacggauggagagcaagauuggccgcugguacucuagaaccaugagcaaaaccgagcggauggggaugggacuguaugugaaguacgacggcgaucccugggcugacuccgaugcgcuggucuucucugggguuauggugagcaugaaggaaccuggcugguacuccuuuggauucgagaucaaagacaagaaaugcgaugugccguguaucggcauugaaaugguccacgacgggggaaaggagacauggcauagcgccgcuaccgccaucuauugccucaugggcucugggcagcugcuuugggauacagugacgggaguugacauggcccuguga

SEQ ID NO: 213181 - RNA, 1401 nt, Artificial Sequence; identical to SEQ ID NO: 211980
  derived and/or modified sequence opt5 from neuraminidase__InfluenzaB__AHL93800

SEQ ID NO: 213182 - RNA, 1401 nt, Artificial Sequence; identical to SEQ ID NO: 211980
  derived and/or modified sequence opt5 from neuraminidase__InfluenzaB__AHL93811

SEQ ID NO: 213183 - RNA, 1401 nt, Artificial Sequence; identical to SEQ ID NO: 212516
  derived and/or modified sequence opt5 from neuraminidase__InfluenzaB__AHL93822

SEQ ID NO: 213184 - RNA, 1401 nt, Artificial Sequence; identical to SEQ ID NO: 211980
  derived and/or modified sequence opt5 from neuraminidase__InfluenzaB__AHL93833

SEQ ID NO: 213185 - RNA, 1401 nt, Artificial Sequence
  derived and/or modified sequence opt5 from neuraminidase__InfluenzaB__AHL93844
augcugcccagcaccauccagacacucacgcuguuccuuaccuccggcggggugcugcucucucuguacgucagcgccucccuuucuuaucugcucuacagcggcauucugcugaaguuuuccccuacagagaucaccgcuccgacaaugccccucgacugcgccaacgcgucuaauguucaagcugugaacagaagcgccaccaaagaagugacacugcuucugccugagcccgaauggaccuauccucggcucuccugucccggaagcacguuccagaaggcccugcuuauuucuccucaccgcuuuggggagaccaaaggaaauuccgcuccgcugaucauuagagaacccuucaucgccugcggcccuaacgaguguaagcauuuugcucucacacacuacgccgcgcagcccgggggauauuacaauggcacccggggcgaucgcaacaaacugagacaucugaucagcgucaagcucgggaagauuccuacaguggaaaauucuaucuuccacauggccgcuugguccggaagcgccugccaugacggcaaagaguggaccuauauugggguugauggacccgacgauaacgcucugcuuaaggugaaauacggcgaggccuacacggacacauaucacucuuacgcgcacaagauccugcggacccaggaauccgccuguaauugcauugggggaaacuguuaucucaugaucacagauggcagcgcuuccggcgucucugagugccgcuuucugaaaauuagagaggggcggaucaucaaggaaauuuucccgaccggacgcgugaagcauaccgaggaauguacaugcggcuuugccagcaauaaaacgaucgagugugcuugcagagacaacuccuacaccgccaagcggccuuucguuaaacuuaauguggaaacagauaccgccgagauucgccugaugugcacagacaccuaucucgauacgcccagaccuaacgacgggagcaucacaggacccugugagucuaauggcgauaagggguccggaggcauuaaaggcggguuuguccaccaacggauggaaagcaagaucggacgcugguacucuagaaccaugagcaaaaccgagcggaugggcauggggcuguaugugaaguacgacggagaccccugggcugauuccgacgcgcuggccuucucuggcgugauggucagcaugaaggaaccugggugguacuccuuuggcuucgagaucaaagauaagaaaugcgacguuccguguauuggaaucgaaauggugcaugauggcgggaaggagacauggcacagcgcugccaccgccauuuauugccucaugggaucuggccagcugcuuugggacacagugacgggggucgauauggcucuguga

SEQ ID NO: 213186 - RNA, 1401 nt, Artificial Sequence; identical to SEQ ID NO: 211980
  derived and/or modified sequence opt5 from neuraminidase__InfluenzaB__AHL93855

SEQ ID NO: 213187 - RNA, 1401 nt, Artificial Sequence; identical to SEQ ID NO: 211980
  derived and/or modified sequence opt5 from neuraminidase__InfluenzaB__AHL93866

SEQ ID NO: 213188 - RNA, 1401 nt, Artificial Sequence; identical to SEQ ID NO: 211980
  derived and/or modified sequence opt5 from neuraminidase__InfluenzaB__AHL93877

SEQ ID NO: 213189 - RNA, 1401 nt, Artificial Sequence; identical to SEQ ID NO: 211980
  derived and/or modified sequence opt5 from neuraminidase__InfluenzaB__AHL93888

SEQ ID NO: 213190 - RNA, 1401 nt, Artificial Sequence
  derived and/or modified sequence opt5 from neuraminidase__InfluenzaB__AHL93899
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcgaaccuaacgaguguaagcacuucgcucugacccauuacgccgcgcagcccggcggguauuacaauggaacacggggcgaccgcaacaaacucagacaccugaucagcgucaagcugggcaagauuccuaccguggaaaauucuaucuuucauauggccgcuugguccgggagcgccugccacgauggaaaagaguggacauauauuggcguugacgggcccgauaacaaugcucuccugaagaucaaauacggagaggccuacaccgacacguaucacucuuacgcgaacaauauucuucggacacaggaauccgccuguaacugcaucggcgggaauuguuaucugaugauuaccgauggaagcgcuuccggcgugucugagugccgcuuccucaagaucagagagggccggaucauuaaagaaaucuuuccgacagggcgcgucaagcauaccgaggaauguaccugcggauucgccagcaacaagacaauugagugugcuugcagagacaauuccuacacggccaaacggccuuuugugaagcugaacguugaaaccgauacagccgagauccgccuuaugugcaccgacacauaucuggauacccccagaccugacgauggcagcacgacagggcccugugagucuaacggagacaaaggcuccgggggaauuaagggcggcuucgugcaccagcggauggcuagcaaaaucgggcgcugguacucuagaaccaugagcaagaccgaacggaaaggaaugggccucuaugucaaguacgacggggaucccuggacagacuccgaugcgcuggccuuuagaggagugauggugucuaugaaggagccuggcugguacagcuucggguucgaaaucaaagacaagaaaugcgaugucccguguauuggcaucgagaugguucaugacggaggcaaggaaaccuggcacuccgcugccacagccauuuauugccugauggggagcggacaacuccugugggauacggugaccggcguggacauggcucuuuga

SEQ ID NO: 213191 - RNA, 1401 nt, Artificial Sequence
  derived and/or modified sequence opt5 from neuraminidase__InfluenzaB__AHL93910
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaauguacgugcagagacaauuccuacaccgcuaaacggccuuuugugaagcugaacguugagacagauaccgccgaaauccgccuuaugugcacagacaccuaucuggauacgcccagaccugacgaugggggaauuacaggccccugugagagcaacggggacaaaggaucuggcggcaucaaagggggauucgugcaccagcggauggccuccaagaucggccgcugguacagcagaaccaugucuaagaccgagcggaaagggaugggacucuaugucaaguacgacggcgaucccuggacagacagcgaugcucuggcguuuagaggggugaugguguccaugaaggaaccuggcugguacucuuucggauucgagauuaaagacaagaaaugcgaugucccguguaucggcauugaaaugguucaugacgggggaaaggagaccuggcacagcgccgcuacagccaucuauugccugaugggcuccgggcaacuccugugggauacggugaccggaguggacauggcccuuuga

SEQ ID NO: 213192 - RNA, 1401 nt, Artificial Sequence; identical to SEQ ID NO: 211980
  derived and/or modified sequence opt5 from neuraminidase__InfluenzaB__AHL93921

SEQ ID NO: 213193 - RNA, 1401 nt, Artificial Sequence
  derived and/or modified sequence opt5 from neuraminidase__InfluenzaB__AHL93932
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucauggucacagauggcagcgcuuccggcgugucugaaugccgcuuucugaaaaucagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggagagcaagauuggacgcugguacucuagaaccaugagcaaaaccgaacggaugggcauggagcuguaugugaaguacgacggggaucccugggcugacuccgaugcgcuggccuucucuggagucaugguuagcaugaaggaaccuggcugguacuccuuuggguucgagaucaaagacaagaaaugcgaugugccguguaucggcauugaaauggugcacgacggaggcaaggagacauggcauagcgcugccaccgccaucuauugccucauggggucuggacagcugcuuugggauacagucacgggcguggacauggcucuguga

SEQ ID NO: 213194 - RNA, 1401 nt, Artificial Sequence; identical to SEQ ID NO: 212143
  derived and/or modified sequence opt5 from neuraminidase__InfluenzaB__AHL93943

SEQ ID NO: 213195 - RNA, 1401 nt, Artificial Sequence; identical to SEQ ID NO: 211980
  derived and/or modified sequence opt5 from neuraminidase__InfluenzaB__AHL93954

SEQ ID NO: 213196 - RNA, 1401 nt, Artificial Sequence
  derived and/or modified sequence opt5 from neuraminidase__InfluenzaB__AHL93965
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacuguagcgccacaaaaggagugacccugcuucugccugaacccgaguggacauauccuagacucuccugccccggcagcaccuuccagaaggcucugcuuauuucuccucaccgguuuggggaaacgaaaggaaauuccgccccgcugaucauucgcgagcccuucaucgcuuguggcccuaacgaaugcaagcauuuugcccucacccacuacgcggcccagcccgggggauauuacaauggcacaagaggcgaccggaacaaacugcgccaucugaucagcgucaagcucgggaagauuccuaccguggaaaauucuaucuuccacauggcugccugguccggaagcgcuugucaugauggcaaagaguggacauauauugggguugacggacccgauaacaaugcccugcuuaaggugaaauacggcgaggcguacaccgacacguaucacucuuacgccaacaagauccugagaacacaggaguccgcuugcaauuguauugggggaaacugcuaucucaugaucaccgauggcagcgccuccggcgucucugaaugucgguuucugaaaauucgcgaggggagaaucaucaaggagauuuucccgacaggacgggugaagcacaccgaagagugcaccuguggcuuugcuagcaauaaaacaaucgaaugcgccugccgcgacaacuccuacacggccaagagaccuuucguuaaacuuaauguggagaccgauacagcugaaauucggcugauguguaccgacacauaucucgauacgccccgcccuaacgacgggagcaucaccggacccugcgagucugauggcgacaaggggaacggaggcauuaaaggcggguuuguccaucaaagaauggaguccaagaucggacggugguacagccgcacaaugucuaaaaccgaaagaaugggcauggggcuguaugugaaguacgacggagaucccugggcggacagcgaugcccuggcuuucuccggcgugauggucucuaugaaggagccugggugguacagcuuuggcuucgaaaucaaagacaagaaaugugauguuccgugcauuggaaucgagauggugcacgacggcgggaaggaaaccuggcauuccgccgccacagcuauuuauugucucaugggaagcggccagcugcuuugggauaccgugacaggggucgacauggcccuguga

SEQ ID NO: 213197 - RNA, 1401 nt, Artificial Sequence; identical to SEQ ID NO: 211899
  derived and/or modified sequence opt5 from neuraminidase__InfluenzaB__AHL93976

SEQ ID NO: 213198 - RNA, 1401 nt, Artificial Sequence; identical to SEQ ID NO: 213170
  derived and/or modified sequence opt5 from neuraminidase__InfluenzaB__AHL93987

SEQ ID NO: 213199 - RNA, 1401 nt, Artificial Sequence
  derived and/or modified sequence opt5 from neuraminidase__InfluenzaB__AHL93998
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaauuaaaggaaauuccgccccucugaucaucagagagccguucauugcuugcggccccaccgaauguaagcauuuugcccucacgcacuacgcggcccagccugggggauauuacaacggcacccgggaggaccgcaauaaacugagacaucugaucagcgucaagcucggcaagauucccacaguggagaacucuaucuuccacauggcugccugguccgggagcgcuugccaugauggaaaagaauggaccuauauuggcguugacgggccugauucuaaugcccugcuuaagaucaaauacggagaggcguacacagacaccuaucacuccuacgccaagaacauucugcggacgcaagaaagcgcuuguaauugcaucggcggggauuguuaucucaugaucacagacggacccgccuccggcgugucugagugccgcuuucugaaaauuagagagggccggaucauuaaggaaaucuucccgaccgggcgcgucaagcacacagaggaauguaccugcggauuugcuagcaacaaaaccauugagugugccugcagagauaaucgguacacagccaagcgcccuuucgugaaacuuaacguugaaacggacaccgcugagaucagacugaugugcacagagaccuaucucgauacaccccggccuaaugacggcuccaucaccgggcccugugaaagcgauggagacaagggcucugggggaauuaaaggcggcuuugugcaucagcgcauggcguccaagaucgggagaugguacagccggacgaugucuaaaacaaagagaaugggaaugggccuguaugucaaguacgacggggaucccuggaccgacagcgaggcccuggcucucuccggagugauggugucuauggaggaaccuggcugguacagcuucggguuugaaauuaaagauaagaaaugcgacgucccguguaucggcauugagaugguucacgauggaggcaagaccacauggcauuccgccgccaccgcuaucuauugccugauggggagcggacagcuucugugggacacagugacgggcguggauauggcccucuga

SEQ ID NO: 213200 - RNA, 1401 nt, Artificial Sequence
  derived and/or modified sequence opt5 from neuraminidase__InfluenzaB__AHL94009
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccaaguggacauauccucggcuguccugucccggcagcaccuuucaaaaagcccuccugauuucuccucaucgcuucggggagacgaagggaaauuccgcuccgcuuaucauuagagaacccuuuaucgccugcggcccuaacgagugucggcacuucgcucugacccauuacgccgcgcagcccgggggauauuacaauggcacacgcggcgacagaaacaaacuccggcaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucgcacacaggaauccgccuguaacugcaucgggggaaauuguuaucugaugauuaccgauggcagcgcuuccggcgugucugagugcagauuccucaagauccgggaagggcgcaucauuaaagagaucuuuccgacaggaagagucaagcauaccgaggaauguaccugcggcuucgccagcaacaagacaauugagugugcuugccgggacaauuccuacacggccaaacgcccuuuugugaagcugaacguugaaaccgauacagccgagaucagacuuaugugcaccgacacauaucuggauacgccccggccugacgaugggagcauuaccggacccugugaaucuaacggcgacaaaggguccggaggcaucaagggcggguucgugcaccagcgcauggcuagcaaaaucggaagaugguacucucggacaaugagcaagaccgagagaaaaggcauggggcucuaugucaaguacgacggagaucccuggaccgacuccgaugcgcuggccuuucgcggcgugauggugucuaugaaggagccugggugguacagcuucggcuucgaaauuaaagacaagaaaugcgaugucccguguaucggaauugagaugguucaugacggcgggaaggaaacauggcacuccgcugccaccgccaucuauugccugaugggaagcggccaacuccugugggauacagugacggggguggacauggcucuuuga

SEQ ID NO: 213201 - RNA, 1401 nt, Artificial Sequence; identical to SEQ ID NO: 211980
  derived and/or modified sequence opt5 from neuraminidase__InfluenzaB__AHL94020

SEQ ID NO: 213202 - RNA, 1401 nt, Artificial Sequence; identical to SEQ ID NO: 211980
  derived and/or modified sequence opt5 from neuraminidase__InfluenzaB__AHL94031

SEQ ID NO: 213203 - RNA, 1401 nt, Artificial Sequence; identical to SEQ ID NO: 212143
  derived and/or modified sequence opt5 from neuraminidase__InfluenzaB__AHL94042

SEQ ID NO: 213204 - RNA, 1401 nt, Artificial Sequence
  derived and/or modified sequence opt5 from neuraminidase__InfluenzaB__AHL94053
augcugcccagcaccauccagacacucacgcuguuccuuaccuccggcggggugcugcucucucuguaccuuagcgcccugcucuccuaucugcuguacucugacauucuccugaaguuuagcccuacagagaucaccgcuccgacaaugucccuugauugcgccaacgcgucuaauguccaagcuguuaacagaagcgccaccaaaggagugacauuccugcuccccgaaccugaguggaccuauccccggcuguccuguccuggcagcacguuucagcgcgcccuucugauuucuccccacagauucggggaaaccaagggaaauuccgcuccucucaucauucgggagccguuuaucgccugcggccccaacgaauguaaacauuucgcucugacacacuacgccgcgcagccugggggauauuacaauggcacccgcggcgacagaaacaagcugcggcaucucaucagcgugaaacuggggaagauucccacagucgaaaauucuaucuuucacauggccgcuugguccggaagcgccugccaugauggcaaggaguggaccuauauugggguggacggaccugauaacgacgcccuucugaaaguuaaguacggcgaggcuuacacggauacauaucacucuuacgcgaauaaaauccuccgcacccaggaguccgccuguaacugcauugggggaaauuguuaucugaugaucacagacggcagcgcuuccggcgugucugaaugcagauuccuuaagauucgggaggggcgcaucaucaaagagauuuuucccaccggaagagucaagcacaccgaagaguguacaugcggcuucgccagcaacaagacgaucgaaugugcuugccgggauaauuccuacaccgccaaacgcccguuugugaagcugaacguugagacagacaccgccgaaauuagacucaugugcacagauaccuaucuggacacgccucggcccgaugacgggagcaucacaggaccuugugagucuaauggcgacaaaggguccggaggcauuaagggcggguucgugcaucaacgcauggagagcaaaaucggaagaugguacucucggaccaugagcaagaccgaaagaaugggcauggggcuguaugucaaauacgauggagaccccugggcugauuccgacgcgcucgccuuuucuggcgugauggugagcaugaaggagcccgggugguacuccuucggcuucgaaaucaaggauaaaaagugcgacgucccuuguauuggaaucgagaugguucacgauggcgggaaagaaacauggcauagcgcugccaccgccauuuauugccugaugggaucuggccagcuucugugggacacagugacggggguggauauggcucucuga

SEQ ID NO: 213205 - RNA, 1401 nt, Artificial Sequence; identical to SEQ ID NO: 211980
  derived and/or modified sequence opt5 from neuraminidase__InfluenzaB__AHL94064

SEQ ID NO: 213206 - RNA, 1401 nt, Artificial Sequence; identical to SEQ ID NO: 211980
  derived and/or modified sequence opt5 from neuraminidase__InfluenzaB__AHL94075

SEQ ID NO: 213207 - RNA, 1401 nt, Artificial Sequence
  derived and/or modified sequence opt5 from neuraminidase__InfluenzaB__AHL94086
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugaccuuccugcuucccgaaccugaguggacauauccccgccuguccuguccuggcagcaccuuucagaaggcccuccugaucucuccccacagauucggggaaacgaaaggaaauuccgcuccucuuauuauccgggagccguuugucgccugcggccccaaggaauguaaacauuucgcucugacccacuacgccgcgcagccugggggauauuacaacggcacacgcgaggacagaaauaagcuccggcaucugaucagcgugaagcugggcaaaauucccaccguugagaacucuaucuuucacauggccgcuugguccgggagcgccugccaugauggacgcgaauggacauauauuggcguggacgggccugauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggacccgcuuccggcaucucugagugccgguuccucaaaauccgcgagggcagaauuaucaaggaaauuuuuccgacagggcgggucaagcacaccgaggaauguaccugcggauucgccagcaacaaaacaaucgagugugcuugccgcgauaauuccuacacggccaagagaccuuuugugaaacugaacguugaaaccgacacagccgagauucggcuuaugugcaccgagacauaucuggauacgccccgcccuaaugacggcagcaucaccgggcccugugaaucuaacggagauaagggcuccgggggaaucaaaggcggcuucgugcaucaaagaauggcuagcaagauugggcggugguacucuagaacaaugagcaaaaccaagcgcaugggaaugggccucuaugucaaguacgacggggaccccuggaccgauuccgaggcgcuggcccugucuggagugauggugagcauggaggaaccuggcugguacuccuuuggguucgaaaucaaagacaagaaaugcgaugucccguguauuggcaucgagaugguucacgacggaggcaagacaaccuggcauagcgcugccacagccauuuauugccucauggggucuggacagcugcuuugggauacggugaccggcgugaauaugacacuguga

SEQ ID NO: 213208 - RNA, 1401 nt, Artificial Sequence; identical to SEQ ID NO: 212143
  derived and/or modified sequence opt5 from neuraminidase__InfluenzaB__AHL94095

SEQ ID NO: 213209 - RNA, 1401 nt, Artificial Sequence; identical to SEQ ID NO: 211980
  derived and/or modified sequence opt5 from neuraminidase__InfluenzaB__AHL94106

SEQ ID NO: 213210 - RNA, 1401 nt, Artificial Sequence
  derived and/or modified sequence opt5 from neuraminidase__InfluenzaB__AHL94117
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaaggguccggaggcaucaagggcggguucgugcaccagcggauggcuagcaaaaucggacgcugguacucuagaacaaugagcaagaccgagcggaaaggcauggggcuccaugucaaguaugacggagaucccuggaccgacuccgaugcgcuggccuuuagaggcgugauggugucuaugaaggaaccugggugguacagcuucggcuucgagauuaaagacaagaaaugcgaugucccguguaucggaauugaaaugguucacgacggcgggaaggagacauggcacuccgcugccaccgccaucuacugccugaugggaagcggccaacuccugugggauacagugacgggggugaauauggcucuuuga

SEQ ID NO: 213211 - RNA, 1401 nt, Artificial Sequence; identical to SEQ ID NO: 211980
  derived and/or modified sequence opt5 from neuraminidase__InfluenzaB__AHL94128

SEQ ID NO: 213212 - RNA, 1401 nt, Artificial Sequence
  derived and/or modified sequence opt5 from neuraminidase__InfluenzaB__AHL94139
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcccgaaccugaguggaccuauccccggcucuccuguccuggcagcacguuucagcgcgcccugcuuauuucuccccacagauucggggaaaccaagggaaauuccgcuccucugaucauucgggagccguuuaucgccugcggccccaacgaauguaaacauuucgcucucacacacuacgccgcgcagccugggggauauuacaauggcacccgcggcgacagaaacaagcugcggcaucugaucagcgucaaacucgggaagauucccacaguggaaaauucuaucuuucacauggccgcuugguccggaagcgccugccaugauggcaaggaguggaccuauauugggguugacggaccugauaacgacgcucugcuuaaagugaaguacggcgaggccuacacggauacauaucacucuuacgcgaauaaaauccugcgcacccaggaguccgccuguaacugcauugggggaaauuguuaucucaugaucacagacggcagcgcuuccggcgucucugaaugcagauuccugaagauucgggaggggcgcaucaucaaagagauuuuucccaccggaagagugaagcacaccgaagaguguacaugcggcuucgccagcaacaagacgaucgaaugugcuugccgggauaauuccuacaccgccaaacgcccguuuguuaaacuuaacguggagacagacaccgccgaaauuaagcugaugugcacagauaccuaucucgacacgccuagacccgaugacgggagcaucacaggaccuugugagucuaauggcgacaagggguccggaggcauuaaaggcggguucguccaucaacggauggagagcaagaucggacgcugguacucuagaaccaugagcaaaaccgaacggaugggcauggggcuguaugugaaguacgauggagaccccugggcugauuccgacgcgcuggccuuuucuggcgugauggucagcaugaaggagcccgggugguacuccuucggcuucgaaaucaaagauaagaaaugcgacguuccuuguauuggaaucgagauggugcacgauggcgggaaggaaacauggcauagcgcugccaccgccauuuauugccucaugggaucuggccagcugcuuugggacacagugacgggggucgauauggcucuguga

SEQ ID NO: 213213 - RNA, 1401 nt, Artificial Sequence; identical to SEQ ID NO: 213170
  derived and/or modified sequence opt5 from neuraminidase__InfluenzaB__AHL94150

SEQ ID NO: 213214 - RNA, 1401 nt, Artificial Sequence
  derived and/or modified sequence opt5 from neuraminidase__InfluenzaB__AHL94161
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccaaaauccgccuuaugugcaccgacacauaucuggauacccccagaccugacgaugggagcauuacgggacccugugaaucuaacggcgacaagggguccggaggcaucaaaggcggguucgugcaccagcggauggcuagcaagaucggacgcugguacucuagaacaaugagcaaaaccgagcggaagggcauggggcucuaugucaaguacgacggagaucccuggaccgacuccgaugcgcuggccuuuagaggcgugauggugucuaugaaagagccugggugguacagcuucggcuucgaaauuaaggacaaaaagugcgaugucccguguaucggaauugagaugguucaugacggcgggaaagaaacauggcacuccgcugccaccgccaucuauugccugaugggaagcggccaacuccugugggauacagugacggggguggacauggcucuuuga

SEQ ID NO: 213215 - RNA, 1401 nt, Artificial Sequence; identical to SEQ ID NO: 213170
  derived and/or modified sequence opt5 from neuraminidase__InfluenzaB__AHL94183

SEQ ID NO: 213216 - RNA, 1404 nt, Artificial Sequence
  derived and/or modified sequence opt5 from neuraminidase__InfluenzaB__AHL94194
augcugcccagcaccauccagacacucacgcuguuccuuaccuccggcggggugcugcucucucuguacgucagcgcccuucuguccuaucuccuguacucugacauucugcucaaguuuagcccuacagagaucaccgcuccgacaaugucccuggauugcgccaacgcgucuaauguucaagcugugaacagaagcgccaccaaaggagugacauuccuucugcuccccgaaccugaguggaccuauccccggcuguccuguccuggcagcacguuucagcgcgcccuucugauuucuccccacagauucggggaaaccaagggaaauuccgcuccucucaucauucgggagccguuuaucgccugcggccccaacgaauguaaacauuucgcucugacacacuacgccgcgcagccugggggauauuacaauggcacccgcggcgacagaaacaagcugcggcaucucaucagcgucaaacuggggaagauucccacaguggaaaauucuaucuuucacauggccgcuugguccggaagcgccugccaugauggcaaggaguggaccuauauugggguugacggaccugauaacgacgcccuucugaaagugaaguacggcgaggcuuacacggauacauaucacucuuacgcgaauaaaauccuccgcacccaggaguccgccuguaacugcauugggggaaauuguuaucugaugaucacagacggcagcgcuuccggcgucucugaaugcagauuccuuaagauucgggaggggcgcaucaucaaagagauuuuucccaccggaagagugaagcacaccgaagaguguacaugcggcuucgccagcaacaagacgaucgaaugugcuugccgggauaauuccuacaccgccaaacgcccguuuguuaagcugaacguggagacagacaccgccgaaauuagacucaugugcacagauaccuaucuggacacgccucggcccgaugacgggagcaucacaggaccuugugagucuaauggcgacaaaggguccggaggcauuaagggcggguucguccaucaacgcauggagagcaaaaucggaagaugguacucucggaccaugagcaagaccgaaagaaugggcauggggcuguaugugaaauacgauggagaccccugggcugauuccgacgcgcucgccuuuucuggcgugauggucagcaugaaggagcccgggugguacuccuucggcuucgaaaucaaggauaaaaagugcgacguuccuuguauuggaaucgagauggugcacgauggcgggaaagaaacauggcauagcgcugccaccgccauuuauugccugaugggaucuggccagcuucugugggacacagugacgggggucgauauggcucucuga

SEQ ID NO: 213217 - RNA, 1401 nt, Artificial Sequence; identical to SEQ ID NO: 211980
  derived and/or modified sequence opt5 from neuraminidase__InfluenzaB__AHL94205

SEQ ID NO: 213218 - RNA, 1401 nt, Artificial Sequence; identical to SEQ ID NO: 212143
  derived and/or modified sequence opt5 from neuraminidase__InfluenzaB__AHL94214

SEQ ID NO: 213219 - RNA, 1401 nt, Artificial Sequence
  derived and/or modified sequence opt5 from neuraminidase__InfluenzaB__AHL94224
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgggggaaauuguuaucugaugauuaccgauggcagcgcuuccggcgugucugaaugccgcuuccucaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaagcugaacguugagaccgauacagccgaaauccgccuuaugugcaccgacacauaucuggauacccccagaccugacgaugggagcauuacgggacccugugagucuaacggcgacaaaggguccggaggcaucaagggcggguucgugcaccagcggauggcuagcaaaaucggacgcugguacucuagaacaaugagcaagaccgagcggaaaggcauggggcucuaugucaaguacgacggagaucccuggauugacuccgaugcgcuggccuuuagaggcgugauggugucuaugaaggaaccugggugguacagcuucggcuucgagaucaaagacaagaaaugcgaugucccguguauuggaaucgaaaugguucaugacggcgggaaggagaccuggcacuccgcugccacagccauuuauugccugaugggaagcggccaacuccugugggauaccgugacagggguggacauggcucuuuga

SEQ ID NO: 213220 - RNA, 1401 nt, Artificial Sequence; identical to SEQ ID NO: 211980
  derived and/or modified sequence opt5 from neuraminidase__InfluenzaB__AHL94235

SEQ ID NO: 213221 - RNA, 1401 nt, Artificial Sequence; identical to SEQ ID NO: 212143
  derived and/or modified sequence opt5 from neuraminidase__InfluenzaB__AHL94246

SEQ ID NO: 213222 - RNA, 1401 nt, Artificial Sequence; identical to SEQ ID NO: 212143
  derived and/or modified sequence opt5 from neuraminidase__InfluenzaB__AHL94257

SEQ ID NO: 213223 - RNA, 1401 nt, Artificial Sequence; identical to SEQ ID NO: 211841
  derived and/or modified sequence opt5 from neuraminidase__InfluenzaB__AHL94267

SEQ ID NO: 213224 - RNA, 1401 nt, Artificial Sequence; identical to SEQ ID NO: 211841
  derived and/or modified sequence opt5 from neuraminidase__InfluenzaB__AHL94278

SEQ ID NO: 213225 - RNA, 1401 nt, Artificial Sequence; identical to SEQ ID NO: 211841
  derived and/or modified sequence opt5 from neuraminidase__InfluenzaB__AHL94299

SEQ ID NO: 213226 - RNA, 1401 nt, Artificial Sequence
  derived and/or modified sequence opt5 from neuraminidase__InfluenzaB__AHL94310
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacaccccugcuuccugaacccgaguggaccuauccucgccuguccugucccggcagcaccuuccagaaggcccuccugaucucuccucacagauuuggggaaacgaaaggaaauuccgcuccgcuuauuauccgggagcccuucaucgccugcggcccuaaggaauguaaacauuuugcucugacccacuacgccgcgcagcccgggggauauuacaacggcacacgcgaggacagaaauaagcuccggcaucugauuagcgucaagcugggcaaaaucccuaccguggagaacucuauuuuccacauggccgcuugguccgggagcgccugccaugauggacgcgaauggacauauaucggcguugacgggcccgauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggauccgcuucuggcaucagcgagugccgguuucucaaaauucgcgagggcagaaucauuaaggaaaucuucccgacagggcgggugaagcacaccgaggaauguaccugcggauuugccuccaacaaaacaauugagugugcuugccgcgauaauagcuacacggccaagagaccuuucgucaaacugaacguggaaaccgacacagccgagauccggcuuaugugcaccgagacauaucuggauacgccccgcccuaaugacggcucuaucgcugggcccugugaauccaacggagaugagggcagcgggggaauuaagggcggcuuuguucaucaaagaauggcgucuaaaaucgggcggugguacagcagaaccauguccaagacaaaacgcaugggaaugggccucuaugugaaguacgacggggaccccuggaccgauucugaagcccuggcucugagcggagucaugguguccauggaggaaccuggcugguacagcuucggguuugagauuaaggacaaaaagugcgaugugccguguaucggcauugagaugguccacgacggaggcaaaaccacauggcauucugccgccaccgcuaucuauugccucaugggguccggacagcugcuuugggauacaguuacgggcgugaauaugacccuguga

SEQ ID NO: 213227 - RNA, 1401 nt, Artificial Sequence; identical to SEQ ID NO: 213226
  derived and/or modified sequence opt5 from neuraminidase__InfluenzaB__AHL94321

SEQ ID NO: 213228 - RNA, 1401 nt, Artificial Sequence
  derived and/or modified sequence opt5 from neuraminidase__InfluenzaB__AHL94332
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacaccccugcuuccugaacccgaguggaccuauccucgccuguccugucccggcagcaccuuccagaaggcccuccugaucucuccucacagauuuggggaaacgaaaggaaauuccgcuccgcuuauuauccgggagcccuucaucgccugcggcccuaaggaauguaaacauuuugcucugacccacuacgccgcgcagcccgggggauauuacaacggcacacgcgaggacagaaauaagcuccggcaucugauuagcgucaagcugggcaaaaucccuaccguggagaacucuauuuuccacauggccgcuugguccgggagcgccugccaugauggacgcgaauggacauauaucggcguugacgggcccgauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggaccggcuuccggcaucucugagugccgguuucucaaaauucgcgagggcagaaucauuaaggaaaucuucccuacagggcgggugaagcacaccgaggaauguaccugcggauuugccagcaacaaaacaauugagugugcuugccgcgauaauuccuacacggccaagagacccuucgucaaacugaacguggaaaccgacacagccgagauccggcuuaugugcaccgagacauaucuggauaccccucgccccaaugacggcagcaucacggggcccugugaaucuaacggagaugagggcuccgggggaauuaagggcggcuuuguucaucaaagaauggcuagcaaaaucgggcggugguacucuagaacaaugagcaagaccaaacgcaugggaaugggccucuaugugaaguacgacggggacccuuggaccgauuccgaagcgcuggcccugucuggagucauggugagcauggaggaaccgggcugguacuccuucggguuugagauuaaggacaaaaagugcgaugugcccuguaucggcauugagaugguccacgacggaggcaaaacaaccuggcauagcgcugccacagccaucuauugccucauggggucuggacagcugcuuugggauacgguuaccggcgugaauaugacacuguga

SEQ ID NO: 213229 - RNA, 1401 nt, Artificial Sequence; identical to SEQ ID NO: 211841
  derived and/or modified sequence opt5 from neuraminidase__InfluenzaB__AHL94343

SEQ ID NO: 213230 - RNA, 1401 nt, Artificial Sequence
  derived and/or modified sequence opt5 from neuraminidase__InfluenzaB__AHL94354
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccugggcugacagcgaugcgcuggccuucuccggcgugauggucucuaugaaagaaccugggugguacagcuuuggcuucgagaucaaggacaaaaagugcgauguuccguguauuggaaucgaaauggugcacgacggcgggaaagagacauggcauuccgcugccaccgccauuuauugccucaugggaagcggccagcugcuuugggauacagugacgggggucgacauggcucuguga

SEQ ID NO: 213231 - RNA, 1401 nt, Artificial Sequence; identical to SEQ ID NO: 213230
  derived and/or modified sequence opt5 from neuraminidase__InfluenzaB__AHL94365

SEQ ID NO: 213232 - RNA, 1401 nt, Artificial Sequence
  derived and/or modified sequence opt5 from neuraminidase__InfluenzaB__AHL94387
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaccguucaagcugugaauagaagcgccacaaaaggagugacccugcuucugccugaacccgaguggacguauccucggcucuccugucccggcagcaccuuccagaaggcccugcuuauuucuccucaccgcuuuggggaaacaaaaggaaacuccgcuccgcugaucauuagagagcccuucaucgccugcggcccuaaugaauguaagcauuuugcucucacccacuacgccgcgcagcccgggggauauuacaacggcacacggggcgaccgcaauaaacugagacaucugaucagcgucaagcucgggaagauuccuaccguggagaacucuaucuuccacauggccgcuugguccggaagcgccugccaugauggcaaagaguggacguaucuggggguugacggacccgauaauaacgcucugcuuaaggugaaauacggcgaagccuacacagacaccuaucacucuuacgcgaauaagauucuccggacacaggaguccgccuguaacugcaucgggggaaauuguuaucugaugauuaccgauggcagcgcuuccggcgucucugaaugccgcuuucuuaaaaucagagaggggcggauuaucaaggagaucuucccgaccggacgcgugaagcacacagaagaguguacgugcggcuuugccagcaacaaaaccauugaaugugcuugcagagacaaucgguacacagccaagcgcccuuucguuaaacugaacguggagaccgauacagccgaaaucagacucaugugcaccgacacguaucuggauacaccccggccuaaugacggguccauuaccggacccugugagagcgauggcgacaaggggucuggaggcaucaaaggcggguuuguccaucaacgcaugaaguccaaaauuggaagaugguacagccggaccaugucuaagacagagagaaugggcauggggcuguaugugaaguacgacggagaucccugggcugacagcgaugcgcucgccuucuccggcgugauggucucuaugaaagaaccugggugguacagcuuuggcuucgagaucaaggacaaaaagugcgauguuccguguaucggaauugaaauggugcacgacggcgggaaagagaucuggcauuccgcugccaccgccauuuauugccugaugggaagcggccagcuucugugggauacagugacgggggucgacauggcucucuga

SEQ ID NO: 213233 - RNA, 1404 nt, Artificial Sequence
  derived and/or modified sequence opt5 from neuraminidase__InfluenzaB__AHL94398
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugcucccugaacccgaguggaccuauccucggcuguccugucccggcagcacguuccagaaggcccuucugauuucuccucaccgcuuuggggaaaccaaaggaaauuccgcuccgcucaucauuagagagcccuucaucgccugcggcccuaacgaauguaagcauuuugcucugacacacuacgccgcgcagcccgggggauauuacaauggcacccggggcgaccgcaacaaacugagacaucucaucagcgucaagcuggggaagauuccuacaguggaaaauucuaucuuccacauggccgcuugguccggaagcgccugccaugauggcaaagaguggaccuauauugggguugacggacccgauaacaaugcccuucugaaggugaaauacggcgaggcuuacacggacacauaucacucuuacgcgaacaagauccuccggacccaggaguccgccuguaauugcauugggggaaacuguuaucugaugaucacagauggcagcgcuuccggcgucucugaaugccgcuuucuuaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacugaauguggagacagauaccgccgaaauuagacucaugugcacagacaccuaucuggauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccugggcugacagcgaugcgcucgccuucuccggcgugauggucucuaugaaagaaccugggugguacagcuuuggcuucgagaucaaggacaaaaagugcgauguuccguguauuggaaucgaaauggugcacgacggcgggaaagagacauggcauuccgcugccaccgccauuuauugccugaugggaagcggccagcuucugugggauacagugacgggggucgacauggcucucuga

SEQ ID NO: 213234 - RNA, 1401 nt, Artificial Sequence; identical to SEQ ID NO: 213230
  derived and/or modified sequence opt5 from neuraminidase__InfluenzaB__AHL94409

SEQ ID NO: 213235 - RNA, 1401 nt, Artificial Sequence
  derived and/or modified sequence opt5 from neuraminidase__InfluenzaB__AHL94431
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccgccaaaggagugacacugauccuucccgaaccugaguggaccuaucccagacuguccuguccuggcagcacauuccagaaggcucuccugauuucuccccaucgguuuggggaaaucaaaggaaauuccgccccucuuaucauucgcgagccguucaucgcuugcggccccaccgaauguaagcacuuugcccugacgcauuacgcggcccagccugggggauauuacaacggcaccagagaggaccggaauaaacuccgccaccugauuagcgucaagcugggcaagauccccacaguggagaacucuauuuuccauauggcugccugguccgggagcgcuugccacgauggaaaagaauggaccuauaucggcguugacgggccugauucuaaugcccuccugaagauuaaauacggagaggcguacacagacaccuaucacuccuacgccaagaacauccuuagaacgcaagaaagcgcuuguaauugcaucggcggggauuguuaucugaugauuacagacggacccgccuccggcgugucugagugccgguuucucaaaauccgcgagggcagaauuaucaaggaaauuuucccgaccgggcgggucaagcauacagaggaauguaccugcggauuugcuagcaacaaaaccaucgagugugccugccgcgauaauagauacacagccaagcggccuuucgugaaacugaacguugaaacggacaccgcugagauccgccuuaugugcacagagaccuaucuggauacacccagaccuaaugacggcuccauuaccgggcccugugaaagcgauggagacaagggcucugggggaaucaaaggcggcuuugugcaccagcggauggcguccaagauugggcgcugguacagcagaacgaugucuaaaacaaagcggaugggaaugggccucuaugucaaguacgacggggaucccuggaccgacagcgaggcccuggcucuguccggagugaugaucucuauggaggaaccuggcugguacagcuucggguuugaaauuaaagauaagaaaugcgacgugccguguaucggcaucgagaugguccaugauggaggcaagaccacauggcacuccgccgccaccgcuauuuauugccucauggggagcggacagcugcuuugggacacaguuacgggcguggauauggcccuguga

SEQ ID NO: 213236 - RNA, 1401 nt, Artificial Sequence
  derived and/or modified sequence opt5 from neuraminidase__InfluenzaB__AHL94442
augcugcccagcaccauccagacacucacgcuguuccuuaccuccggcggggugcugcucucucuguacaugagcgccucccuuucuuaucugcucuacagcgacauucugcugaaguuuuccagaacagagaucaccgcuccuauuaugccgcucgauugcgccaacgcgucuaauguccaagcuguuaaccggagcgccacaaaaggagugacaccccugcuuccugaacccgaguggaccuauccucgccuguccugucccggcagcaccuuccagaaggcccuccugaucucuccucacagauuuggggaaacgaaaggaaauuccgcuccgcuuauuauccgggagcccuucaucgccugcggcccuaaggaauguaaacauuuugcucugacccacuacgccgcgcagcccgggggauauuacaacggcacacgcgaggacagaaauaagcuccggcaucugauuagcgugaagcugggcaaaaucccuaccgucgagaacucuauuuuccacauggccgcuugguccgggagcgccugccaugauggacgcgaauggacauauaucggcguggacgggcccgauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggauccgcuucuggcaucagcgagugccgguuucucaaaauucgcgagggcagaaucauuaaggaaaucuucccgacagggcggguuaagcacaccgaggaauguaccugcggauuugccuccaacaaaacaauugagugugcuugccgcgauaauagcuacacggccaagagaccuuucgugaaacugaacgucgaaaccgacacagccgagauccggcuuaugugcaccgagacauaucuggauacgccccgcccuaaugacggcucuaucgcugggcccugugaauccaacggagaugagggcagcgggggaauuaagggcggcuuugugcaucaaagaauggcgucuaaaaucgggcggugguacagcagaaccauguccaagacaaaacgcaugggaaugggccucuauguuaaguacgacggggaccccuggaccgauucugaagcccuggcucugagcggagugauggucuccauggaggaaccuggcugguacagcuucggguuugagauuaaggacaaaaagugcgaugugccguguaucggcauugagauggugcacgacggaggcaaaaccacauggcauucugccgccaccgcuaucuauugccucaugggguccggacagcugcuuugggauacagucacgggcguuaauaugacccuguga

SEQ ID NO: 213237 - RNA, 1401 nt, Artificial Sequence; identical to SEQ ID NO: 213226
  derived and/or modified sequence opt5 from neuraminidase__InfluenzaB__AHL94464

SEQ ID NO: 213238 - RNA, 1401 nt, Artificial Sequence; identical to SEQ ID NO: 211841
  derived and/or modified sequence opt5 from neuraminidase__InfluenzaB__AHL94475

SEQ ID NO: 213239 - RNA, 1401 nt, Artificial Sequence; identical to SEQ ID NO: 213230
  derived and/or modified sequence opt5 from neuraminidase__InfluenzaB__AHL94486

SEQ ID NO: 213240 - RNA, 1401 nt, Artificial Sequence; identical to SEQ ID NO: 211841
  derived and/or modified sequence opt5 from neuraminidase__InfluenzaB__AHL94497

SEQ ID NO: 213241 - RNA, 1401 nt, Artificial Sequence; identical to SEQ ID NO: 213226
  derived and/or modified sequence opt5 from neuraminidase__InfluenzaB__AHL94508

SEQ ID NO: 213242 - RNA, 1401 nt, Artificial Sequence
  derived and/or modified sequence opt5 from neuraminidase__InfluenzaB__AHL94519
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacuuaauguggagacagauaccgccgaaauucgccugaugugcacagacaccuaucucgauacgcccagaccuaacgacgggagcaucacaggacccugugagucugauggcgacaagggguccggaggcauuaaaggcggguuuguccaucaacggauggagagcaagaucggacgcugguacucuagaaccaugagcaaaaccgaacggaugggcauggggcuguaugugaaguacgacggagaucccuggacagacuccgaugcucuggcguucucuggcgugauggucagcaugaaggagccugggugguacuccuuuggcuucgaaaucaaagacaagaaaugcgauguuccguguauuggaaucgagauggugcacgacggcgggaaggaaaccuggcauagcgccgcuacagccauuuauugccucaugggaucuggccagcugcuuugggauacggugaccggggucgacauggcccuguga

SEQ ID NO: 213243 - RNA, 1401 nt, Artificial Sequence; identical to SEQ ID NO: 213226
  derived and/or modified sequence opt5 from neuraminidase__InfluenzaB__AHL94530

SEQ ID NO: 213244 - RNA, 1401 nt, Artificial Sequence; identical to SEQ ID NO: 213230
  derived and/or modified sequence opt5 from neuraminidase__InfluenzaB__AHL94541

SEQ ID NO: 213245 - RNA, 1401 nt, Artificial Sequence
  derived and/or modified sequence opt5 from neuraminidase__InfluenzaB__AHL94563
augcugcccagcaccauccagacacucacgcuguuccuuacccugggcggggugcuccugucccuuuacgucucugccagccuguccuaucuccuguacucugacauucugcucaaguuuagcagaacagagaucaccgcuccuauuaugccgcuggauugcgccaacgcguccaauguucaagcugugaaccggucugccacaaaaggagugacccuucugcuccccgaaccugaguggacauauccccgccugagcuguccuggcuccaccuuccagaaggcccuucugaucagcccccacagauuuggggaaacgaaaggaaauucugcuccucucauuauccgggagccguucaucgccugcggccccaaggaauguaaacauuuugcucugacccacuacgccgcgcagccugggggauauuacaacggcacacgcgaggacagaaauaagcugcggcaucucauuuccgucaagcugggcaaaauccccaccguggagaacagcauuuuccacauggccgcuuggucuggguccgccugccaugauggacgcgaauggacauauaucggcguugacgggccugauagcaaugcccuucugaagauuaaauacggagaggcuuacaccgacacguaucacucuuacgcgaagaacauccucagaacacaggaauccgccuguaauugcauuggcggggauuguuaucugaugaucaccgacggacccgcuagcggcaucuccgagugccgguuucuuaaaauucgcgagggcagaaucauuaaggaaaucuucccgacagggcgggugaagcacaccgaggaauguaccugcggauuugccucuaacaaaacaauugagugugcuugccgcgauaauagcuacacggccaagagaccuuucgucaaacugaacguggaaaccgacacagccgagauccggcucaugugcaccgagacauaucuggauacgccccgcccuaaugacggcuccaucaccgggcccugugaaagcaacggagauaagggcucugggggaauuaaaggcggcuuuguucaucaaagaauggcuuccaagaucgggcggugguacagcagaacaaugucuaaaaccaagcgcaugggaaugggccuguaugugaaguacgacggggaccccuggaccgauagcgaggcgcucgcccuguccggagucauggugucuauggaggaaccuggcugguacagcuucggguuugaaauuaaagacaagaaaugcgaugugccguguaucggcauugagaugguccacgacggaggcaagacaaccuggcauuccgcugccacagccaucuauugccuuauggggagcggacagcugcucugggauacgguuaccggcgugaauaugacacuguga

SEQ ID NO: 213246 - RNA, 1401 nt, Artificial Sequence; identical to SEQ ID NO: 213199
  derived and/or modified sequence opt5 from neuraminidase__InfluenzaB__AHL94574

SEQ ID NO: 213247 - RNA, 1401 nt, Artificial Sequence
  derived and/or modified sequence opt5 from neuraminidase__InfluenzaB__AHL94585
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaauuaaaggaaauuccgccccucugaucaucagagagccguucauugcuugcggccccaccgaauguaagcauuuugcccucacgcacuacgcggcccagccugggggauauuacaacggcacccgggaggaccgcaauaaacugagacaucugaucagcgucaagcucggcaagauucccacaguggagaacucuaucuuccacauggcugccugguccgggagcgcuugccaugauggaaaagaauggaccuauauuggcguugacgggccugauucuaaugcccugcuuaagaucaaauacggagaggcguacacagacaccuaucacuccuacgccaagaacauucugcggacgcaagaaagcgcuuguaauugcaucggcggggauuguuaucucaugaucacagacggacccgccuccggcgugucugagugccgcuuucugaaaauuagagagggccggaucauuaaggaaaucuucccgaaggggcgcgucaaacacaccgaggaauguacaugcggauuugcuagcaacaagaccauugagugugccugcagagauaaucgguacaccgccaaacgcccuuucgugaaacuuaacguugaaacagacacggcugagaucagacugaugugcaccgagacauaucucgauacaccccggccuaaugacggcuccaucaccgggcccugugaaagcgauggagacaagggcucugggggaauuaagggcggcuuugugcaucagcgcauggcguccaaaaucgggagaugguacagccggaccaugucuaagacgaagagaaugggaaugggccuguaugucaaauacgacggggaucccuggacagacagcgaggcccuggcucucuccggagugauggugucuauggaggaaccuggcugguacagcuucggguuugaaauuaaggauaaaaagugcgacgucccguguaucggcauugagaugguucacgauggaggcaaaaccaccuggcauuccgccgccacagcuaucuauugccugauggggagcggacagcuucugugggacaccgugacaggcguggauauggcccucuga

SEQ ID NO: 213248 - RNA, 1401 nt, Artificial Sequence; identical to SEQ ID NO: 213199
  derived and/or modified sequence opt5 from neuraminidase__InfluenzaB__AHL94596

SEQ ID NO: 213249 - RNA, 1401 nt, Artificial Sequence
  derived and/or modified sequence opt5 from neuraminidase__InfluenzaB__AHL94607
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgccugaaguccaaaaucggaagaugguacagccggaccaugucuaagaccgagagaaugggcauggggcuguaugugaaguacgacggagaucccugggcugacagcgaugcgcucacauucuccggcgugauggucucuaugaaagaaccugggugguacagcuuuggcuucgagaucaaggacaaaaagugcgauguuccguguauuggaaucgaaauggugcacgacggcgggaaagagaccuggcauuccgccgcuacagccauuuauugccugaugggaagcggccagcuucugugggauacggugaccggggucgacauggcccucuga

SEQ ID NO: 213250 - RNA, 1401 nt, Artificial Sequence; identical to SEQ ID NO: 213230
  derived and/or modified sequence opt5 from neuraminidase__InfluenzaB__AHL94618

SEQ ID NO: 213251 - RNA, 1401 nt, Artificial Sequence; identical to SEQ ID NO: 213226
  derived and/or modified sequence opt5 from neuraminidase__InfluenzaB__AHL94628

SEQ ID NO: 213252 - RNA, 1401 nt, Artificial Sequence; identical to SEQ ID NO: 213230
  derived and/or modified sequence opt5 from neuraminidase__InfluenzaB__AHL94639

SEQ ID NO: 213253 - RNA, 1401 nt, Artificial Sequence
  derived and/or modified sequence opt5 from neuraminidase__InfluenzaB__AHL94650
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucauccgcgagauuuucccgaccggaagagugaagcacaccgaagaguguacaugcggcuuugccagcaauaagacgaucgaaugugcuugccgggacaaccgcuacaccgccaaaagaccuuucguuaaacuuaauguggagacagauaccgccgaaauucggcugaugugcacagacaccuaucucgauacgccccgcccuaacgacggguccaucacaggacccugugagagcgauggcgacaaggggucuggaggcauuaagggcggguuuguccaucaaagaaugaaauccaagaucggacggugguacagcagaaccaugucuaaaaccgagcgcaugggcauggggcuguaugugaaguacgacggagaucccugggcugacagcgaugcgcuggccuucuccggcgugauggucucuaugaaggaaccugggugguacagcuuuggcuucgagaucaaagacaagaaaugcgauguuccguguauuggaaucgaaauggugcacgacggcgggaaggagacauggcauuccgcugccaccgccauuuauugccucaugggaagcggccagcugcuuugggauacagugacgggggucgacauggcucuguga

SEQ ID NO: 213254 - RNA, 1401 nt, Artificial Sequence
  derived and/or modified sequence opt5 from neuraminidase__InfluenzaB__AHL94661
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauucaacacaccgaagaguguacaugcggcuuugccagcaauaagacgaucgaaugugcuugcagagacaacuccuacaccgccaaacggccuuucgucaaacuuaauguggagacagauaccgccgaaauucgccugaugugcacaaagaccuaucucgacacgcccagaccugaggaugggagcaucacaggacccugugagucuaacggcgggaagggauccggcggcaucaaagggggauuuguucaucagcggauggcuagcaagauuggccgcugguacucuagaaccaugagcaaaaccgaacggaaggggaugggacuguaugugaaguacaacggcgaccccugggcggauuccgacgcccuggucuucucuggggugauggugagcauggaggaaccuggcugguacuccuuuggauucgagaucaaagacaagaaaugcgaugucccguguauuggcaucgaaaugguucacgacgggggaaaggagacauggcauagcgcugccaccgccauuuauugccucaugggcucugggcagcugcuuugggauacagugacgggagugaauaugacccuguga

SEQ ID NO: 213255 - RNA, 1401 nt, Artificial Sequence
  derived and/or modified sequence opt5 from neuraminidase__InfluenzaB__AHL94672
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacaccccugcuuccugaacccgaguggaccuauccucgccuguccugucccggcagcaccuuccagaaggcccuccugaucucuccucacagauuuggggaaacgaaaggaaauuccgcuccgcuuauuauccgggagcccuucaucgccugcggcccuaaggaauguaaacauuuugcucugacccacuacgccgcgcagcccgggggauauuacaacggcacacgcgaggacagaaauaagcuccggcaucugauuagcgucaagcugggcaaaaucccuaccguggagaacucuauuuuccacauggccgcuugguccgggagcgccugccaugauggacgcgaauggacauauaucggcguugacgggcccgauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggauccgcuucuggcaucagcgagugccgguuucucaaaauucgcgagggcagaaucauuaaggaaaucuucccgacagggcgggugaagcacaccgaggaauguaccugcggauuugccuccaacaaaacaauugagugugcuugccgcgauaauagcuacacggccaagagaccuuucgucaaacugaacguggaaaccgacacagccgagauccggcuuaugugcaccgagacauaucuggauacgccccgcccuaaugacggcucuaucuccgggcccugugaaagcaacggagaugagggcucugggggaauuaagggcggcuuuguucaucaaagaauggcuagcaaaaucgggcggugguacuccagaaccaugucuaagacaaaacgcaugggaaugggccucuaugugaaguacgacggggaccccuggaccgauagcgaagcgcuggcccuguccggagucauggugagcauggaggaaccuggcugguacucuuucggguuugagauuaaggacaaaaagugcgaugugccguguaucggcauugagaugguccacgacggaggcaaaaccacauggcauuccgcugccaccgccaucuauugccucauggggagcggacagcugcuuugggauacaguuacgggcgugaauaugacccuguga

SEQ ID NO: 213256 - RNA, 1401 nt, Artificial Sequence
  derived and/or modified sequence opt5 from neuraminidase__InfluenzaB__AHL94683
augcugcccagcaccauccagacacucacgcuguuccuuaccuccggcggggugcugcucucucuguacgucagcgccucccuuucuuaucugcucuacagcgacauucugcugaaguuuuccagaacagagaucaccgcuccuauuaugccgcucgauugcgccaacgcgucuaauguucaagcugugaaccggagcgccacaaaaggagugacaccccugcuuccugaacccgaguggaccuauccucgccuguccugucccggcagcaccuuccagaaggcccuccugaucucuccucacagauuuggggaaacgaaaggaaauuccgcuccgcuuauuauccgggagcccuucaucgccugcggcccuaaggaauguaaacauuuugcucugacccacuacgccgcgcagcccgggggauauuacaacggcacacgcgaggacagaaauaagcuccggcaucugauuagcgucaagcugggcaaaaucccuaccguggagaacucuauuuuccacauggccgcuugguccgggagcgccugccaugauggacgcgaauggacauauaucggcguugacgggcccgauucuaaugcucuccugaagauuaaauacggagaggccuacaccgacacguaucacuccuacgcgaagaacauccuuagaacacaggaaagcgccuguaauugcauuggcggggauuguuaucugaugaucaccgacggauccgcuucuggcaucagcgagugccgguuucucaaaauucgcgagggcagaaucauuaaggaaaucuucccgacagggcgggugaagcacaccgaggaauguaccugcggauuugccuccaacaaaacaauugagugugcuugccgcgauaauagcuacacggccaagagaccuuucgucaaacugaacguggaaaccgacacagccgagauccggcuuaugugcaccgagacauaucuggauacgccccgcccuaaugacggcucuaucaccgggcccugugaauccaacggaggcgaggggagcggaggcauuaagggcggguuuguucaucaaagaauggcuucuaaaaucggacggugguacagcagaacaauguccaagaccaaacgcaugggcauggggcucuaugugaaguacgauggagaccccuggaccgacucugaagcgcuggcccugagcggcgucaugguguccauggaggaaccugggugguacagcuucggcuuugagauuaaggauaaaaagugcgacgugccguguaucggaauugagaugguccacgauggcgggaaaacaaccuggcauucugcugccacagccaucuauugccucaugggauccggccagcugcuuugggacacgguuaccggggugaauaugacacuguga

SEQ ID NO: 213257 - RNA, 1401 nt, Artificial Sequence
  derived and/or modified sequence opt5 from neuraminidase__InfluenzaB__AHL94694
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccugggcugacagcgaugcgcugacauucuccggcgugauggucucuaugaaagaaccugggugguacagcuuuggcuucgagaucaaggacaaaaagugcgauguuccguguauuggaaucgaaauggugcacgacggcgggaaagagaccuggcauuccgccgcuacagccauuuauugccucaugggaagcggccagcugcuuugggauacggugaccggggucgacauggcccuguga

SEQ ID NO: 213258 - RNA, 1401 nt, Artificial Sequence; identical to SEQ ID NO: 213230
  derived and/or modified sequence opt5 from neuraminidase__InfluenzaB__AHL94705

SEQ ID NO: 213259 - RNA, 1401 nt, Artificial Sequence; identical to SEQ ID NO: 211841
  derived and/or modified sequence opt5 from neuraminidase__InfluenzaB__AHL94716

SEQ ID NO: 213260 - RNA, 1401 nt, Artificial Sequence
  derived and/or modified sequence opt5 from neuraminidase__InfluenzaB__AHL94727
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacaccucuaauguucaagcggugaacagaagcgcuacaaaaggagugacccugcuucugccugaacccgaguggacguauccucggcucuccugucccggcagcaccuuccagaaggcccugcuuauuucuccucaccgcuuuggggaaacaaaaggaaauuccgccccgcugaucauuagagagcccuucaucgcuugcggcccuaaggaauguaaacauuuugcccucacccacuacgcugcccagcccgggggauauuacaacggcacacggggcgaccgcaauaagcugagacaucugaucagcgucaagcucgggaaaauuccuaccguggagaacucuaucuuccacauggcggccugguccggaagcgcuugccaugauggcaaggaguggacguauauugggguugacggacccgauaauaacgcccugcuuaaaaucaaguacggcgaggcuuacacagacaccuaucacucuuacgccaauaacauucugcggacacaggaauccgcguguaauugcaucgggggaaacuguuaucucaugauuaccgauggcagcgccuccggcgugucugaaugccgcuuucugaaaaucagagaggggcggaucauuaaggagaucuucccgaccggacgcauucaacacacagaagaguguacgugcggcuuugcuagcaauaagaccaucgaaugugccugcagagacaacuccuacacagcuaaacggccuuucgucaaacuuaauguggagaccgauacagccgaaauucgccugaugugcaccaagacguaucucgacacacccagaccugaggaugggagcaucaccggacccugugagucuaacggcgggaagggauccggcggcaucaaagggggauuuguucaucagcggauggccagcaagauuggccgcugguacucuagaaccaugagcaaaacagaacggaaggggaugggacuguaugugaaguacaacggcgaccccugggcugauuccgacgcgcuggucuucucuggggugauggugagcauggaggaaccuggcugguacuccuuuggauucgagaucaaagacaagaaaugcgaugucccguguauuggcaucgaaaugguucacgacgggggaaaggagaccuggcauagcgccgcuacagccauuuauugccucaugggcucugggcagcugcuuugggauacggugaccggagugaauaugacacuguga

SEQ ID NO: 213261 - RNA, 1401 nt, Artificial Sequence; identical to SEQ ID NO: 211841
  derived and/or modified sequence opt5 from neuraminidase__InfluenzaB__AHL94738

SEQ ID NO: 213262 - RNA, 1401 nt, Artificial Sequence
  derived and/or modified sequence opt5 from neuraminidase__InfluenzaB__AHL94749
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccugggcugacagcgaugcgcuggccuucuccggcgugauggucucuaugaaagaaccugggugguacagcuuuggcuucgagaucaaggacaaaaagugcgauguuccguguauuggaguggaaauggugcacgacggcgggaaagagacauggcauuccgcugccaccgccaucuauugccucaugggaagcggccagcugcuuugggauacagucacggggguggacauggcucuguga

SEQ ID NO: 213263 - RNA, 1401 nt, Artificial Sequence
  derived and/or modified sequence opt5 from neuraminidase__InfluenzaB__AHL94760
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccgccaaaggagugacacugcuucugcccgaaccugaguggaccuaucccagacucuccuguccuggcagcacauuccagaaggcucugcuuaucucuccccaucgguuuggggaaauuaaaggaaauuccgccccucugaucauccgcgagccguucauugcuugcggccccaccgaauguaagcacuuugcccucacgcauuacgcggcccagccugggggauauuacaacggcaccagagaggaccggaauaaacugcgccaccugaucagcgucaagcucggcaagauucccacaguggagaacucuaucuuccauauggcugccugguccgggagcgcuugccacgauggaaaagaauggaccuauauuggcguugacgggccugauucuaaugcccugcuuaagaucaaauacggagaggcguacacagacaccuaucacuccuacgccaagaacauucugagaacgcaagaaagcgcuuguaauugcaucggcggggauuguuaucucaugaucacagacggacccgccuccggcgugucugagugccgguuucugaaaauucgcgagggcagaaucauuaaggaaaucuucccgaccgggcgggucaagcauacagaggaauguaccugcggauuugcuagcaacaaaaccauugagugugccugccgcgauaauagauacacagccaagcggccuuucgugaaacuuaacguugaaacggacaccgcugagauccgccugaugugcacagagaccuaucucgauacacccagaccuaaugacggcuccaucaccgggcccugugaaagcgauggagacaagggcucugggggaauuaaaggcggcuuugugcaccagcggauggcguccaagaucgggcgcugguacagcagaacgaugucuaaaacaaagcggaugggaaugggccuguaugucaaguacgacggggaucccuggaccgacagcgaggcccuggcucucuccggagugauggugucuauggaggaaccuggcugguacagcuucggguuugaaauuaaagauaagaaaugcgacaucccguguauuggcaucgagaugguccaugauggaggcaagaccacauggcacuccgccgccaccgcuaucuauugccugauggggagcggacagcuucugugggacacaguuacgggcguggauauggcccucuga

SEQ ID NO: 213264 - RNA, 1401 nt, Artificial Sequence; identical to SEQ ID NO: 213230
  derived and/or modified sequence opt5 from neuraminidase__InfluenzaB__AHL94770

SEQ ID NO: 213265 - RNA, 1401 nt, Artificial Sequence; identical to SEQ ID NO: 213228
  derived and/or modified sequence opt5 from neuraminidase__InfluenzaB__AHL94781

SEQ ID NO: 213266 - RNA, 1401 nt, Artificial Sequence; identical to SEQ ID NO: 213226
  derived and/or modified sequence opt5 from neuraminidase__InfluenzaB__AHL94791

SEQ ID NO: 213267 - RNA, 1401 nt, Artificial Sequence; identical to SEQ ID NO: 213257
  derived and/or modified sequence opt5 from neuraminidase__InfluenzaB__AHL94801

SEQ ID NO: 213268 - RNA, 1401 nt, Artificial Sequence; identical to SEQ ID NO: 213226
  derived and/or modified sequence opt5 from neuraminidase__InfluenzaB__AHL94812

SEQ ID NO: 213269 - RNA, 1401 nt, Artificial Sequence; identical to SEQ ID NO: 213226
  derived and/or modified sequence opt5 from neuraminidase__InfluenzaB__AHL94821

SEQ ID NO: 213270 - RNA, 1401 nt, Artificial Sequence; identical to SEQ ID NO: 213230
  derived and/or modified sequence opt5 from neuraminidase__InfluenzaB__AHL94831

SEQ ID NO: 213271 - RNA, 1401 nt, Artificial Sequence
  derived and/or modified sequence opt5 from neuraminidase__InfluenzaB__AHL94840
augcugcccagcaccauccagacacucacgcuguuccuuaccuccggcggggugcugcucucucuguacgucagcgccucccuuucuuaucugcucuacagcggcauucugcugaaguuuuccagaacagagaucaccgcuccuauuaugccgcucgacugcgccaacgcgucuaauguucaagcugugaaccggagcgccacaaaaggagugacccugcuucugcccgaaccugaguggacauauccccgccucuccuguccugggagcaccuuccagaaggcccugcuuaucucuccccacagauuuggagaaacgaaaggcaauuccgcuccucugauuauccgggagccguucaucgccugcgggcccaaggaauguaaacauuuugcucucacccacuacgccgcgcagccuggaggcuauuacaacggcacacgcgaggauagaaauaagcugcggcaucugauuagcgucaagcucgggaaaauccccaccguggagaacucuauuuuccacauggccgcuugguccggaagcgccugccaugacggccgcgaauggacauauaucgggguugauggaccugacucuaaugcucugcuuaagauuaaauacggcgaggccuacaccgauacguaucacuccuacgcgaagaacauccugagaacacaggaaagcgccuguaauugcauugggggagacuguuaucucaugaucaccgauggccccgcuuccggcaucucugagugccgguuucugaaaauucgcgaggggagaaucauuaaggaaaucuucccgacaggacgggugaagcacaccgaggaauguaccugcggcuuugccagcaacaaaacaauugagugugcuugccgcgacaauuccuacacggccaagagaccuuucgucaaacuuaacguggaaaccgauacagccgagauccggcugaugugcaccgagacauaucucgacacgccccgcccuaaugaugggagcaucaccggacccugugaaucuaacggcgacaagggguccggaggcauuaaaggcggguuuguucaucaaagaauggcuagcaagaucggacggugguacucuagaacaaugagcaaaaccaagcgcaugggcauggggcuguaugugaaguacgauggagaccccuggaccgacuccgaggcgcuggcccucucuggcgucauggugagcauggaggaaccugggugguacuccuucggcuuugaaauuaaagauaagaaaugcgacgugccguguaucggaauugagaugguccacgauggcgggaagacaaccuggcauagcgcugccacagccaucuauugccugaugggaucuggccagcuucugugggacacgguuaccggggugaauaugacacucuga

SEQ ID NO: 213272 - RNA, 1401 nt, Artificial Sequence
  derived and/or modified sequence opt5 from neuraminidase__InfluenzaB__AHL94851
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaauuaaaggaaauuccgcuccucugaucaucagagagccguucauugccugcggccccacggaauguaagcauuuugcucucacccacuacgccgcgcagccugggggauauuacaacggcacacgggaggaccgcaauaaacugagacaucugaucagcgucaagcucggcaagauucccaccguggagaacucuaucuuccacauggccgcuugguccgggagcgccugccaugauggaaaagaauggacauauauuggcguugacgggccugauucuaaugcucugcuuaagaucaaauacggagaggccuacaccgacacguaucacuccuacgcgaagaacauucugcggacacaagaaagcgccuguaauugcaucggcggggauuguuaucucaugaucaccgacggacccgcuuccggcgugucugagugccgcuuucugaaaauuagagagggccggaucauuaaggaaaucuucccgacagggcgcgucaagcacaccgaggaauguaccugcggauuugccagcaacaaaacaauugagugugcuugcagagauaaucgguacacggccaagcgcccuuucgugaaacuuaacguugaaaccgacacagccgagaucagacugaugugcaccgagacauaucucgauacgccccggccuaaugacggcuccaucaccgggcccugugaaagcgauggagacaagggcucugggggaauuaaaggcggcuuugugcaucagcgcaugacauccaagaucgggagaugguacagccggaccaugucuaaaaccaagagaaugggaaugggccuguaugucaaguacgacggggaucccuggacagacagcgaggcucuggcgcucuccggagugauggugucuauggaggaaccuggcugguacagcuucggguuugaaauuaaagauaagaaaugcgacgucccguguaucggcauugagaugguucacgauggaggcaagaccacauggcauuccgccgcuacggccaucuauugccugauggggagcggacagcuucugugggacaccgugacaggcguggauauggcccucuga

SEQ ID NO: 213273 - RNA, 1401 nt, Artificial Sequence; identical to SEQ ID NO: 211659
  derived and/or modified sequence opt5 from neuraminidase__InfluenzaB__AHL94862

SEQ ID NO: 213274 - RNA, 1401 nt, Artificial Sequence; identical to SEQ ID NO: 211841
  derived and/or modified sequence opt5 from neuraminidase__InfluenzaB__AHL94873

SEQ ID NO: 213275 - RNA, 1401 nt, Artificial Sequence; identical to SEQ ID NO: 213145
  derived and/or modified sequence opt5 from neuraminidase__InfluenzaB__AHL94884

SEQ ID NO: 213276 - RNA, 1401 nt, Artificial Sequence; identical to SEQ ID NO: 211985
  derived and/or modified sequence opt5 from neuraminidase__InfluenzaB__AHL94893

SEQ ID NO: 213277 - RNA, 1401 nt, Artificial Sequence; identical to SEQ ID NO: 211985
  derived and/or modified sequence opt5 from neuraminidase__InfluenzaB__AHL94904

SEQ ID NO: 213278 - RNA, 1401 nt, Artificial Sequence
  derived and/or modified sequence opt5 from neuraminidase__InfluenzaB__AHL94915
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaaguggugaacagaagcgcuaccaaaggagucacacugcuucugccugaacccgaguggaccuauccucggcucuccugucccggcagcacguuccagaaggcccugcuuauuucuccucaccgcuuuggggaaaccaaaggaaauuccgccccgcugaucauuagagagcccuucaucgcuugcggcccuaacgaauguaagcauuuugcccucacacacuacgcugcccagcccgggggauauuacaauggcacccggggcgaccgcaacaaacugagacaucugaucagcgugaagcucgggaagauuccuacaguugaaaauucuaucuuccacauggcggccugguccggaagcgcuugccaugauggcaaagaguggaccuauauugggguggacggacccgauaacaaugcccugcuuaaggucaaauacggcgaggcuuacacggacacauaucacucuuacgccaacaagauccugcggacccaggaguccgcguguaauugcauugggggaaacuguuaucucaugaucacagauggcagcgccuccggcgugucugaaugccgcuuucugaaaauuagagaggggcggaucaucaaggagauuuucccgaccggacgcguuaagcacaccgaagaguguacaugcggcuuugcuagcaauaaaacgaucgaaugugccugcagagacaacuccuacaccgcuaagcggccuuucgugaaacuuaaugucgagacagauaccgccgaaauucgccugaugugcacagacaccuaucucgauacgcccagaccugacgaugggagcaucacaggacccugugagucuaacggcgacaagggguccggaggcauuaaaggcggguuugugcaucaacggauggagagcaagaucggacgcugguacucuagaaccaugagcaaaaccgaacggaugggcauggggcuguaugugaaguacgacggagaucccugggccgacuccgaugcucuggcguucucuggcgucaugguuagcaugaaggagccugggugguacuccuuuggcuucgaaaucaaagacaagaaaugcgaugugccguguauuggaaucgagauggugcacgacggcgggaaggaaacauggcauagcgccgcuaccgccauuuauugccucaugggaucuggccagcugcuuugggauacagucacggggguggacauggcccuguga

SEQ ID NO: 213279 - RNA, 1401 nt, Artificial Sequence; identical to SEQ ID NO: 213145
  derived and/or modified sequence opt5 from neuraminidase__InfluenzaB__AHL94926

SEQ ID NO: 213280 - RNA, 1401 nt, Artificial Sequence
  derived and/or modified sequence opt5 from neuraminidase__InfluenzaB__AHL94937
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacacucccccuggauugcgccaacgcgucuaauguucaagcugugaacagaagcgccaccaaaggagugacacuucugcucccugaacccgaguggaccuauccucggcuguccugucccggcagcacguuccagaaggcccuucugauuucuccucaccgcuuuggggaaaccaaaggaaauuccgcuccgcucaucauuagagagcccuucaucgccugcggcccuaacgaauguaagcauuuugcucugacacacuacgccgcgcagcccgggggauauuacaauggcacccggggcgaccgcaacaaacugagacaucucaucagcgucaagcuggggaagauuccuacaguggaaaauucuaucuuccacauggccgcuugguccggaagcgccugccaugauggcaaagaguggaccuauauugggguugacggacccgauaacaaugcccuucugaaggugaaauacggcgaggcuuacacggacacauaucacucuuacgcgaacaagauccuccggacccaggaguccgccuguaauugcauugggggaaacuguuaucugaugaucacagauggcagcgcuuccggcgucucugaaugccgcuuucuuaaaauuagagaggggcggaucaucaaggagauuuucccgaccggacgcgugaagcacaccgaagaguguacaugcggcuuugccagcaauaaaacgaucgaaugugcuugcagagacaacuccuacaccgccaagcggccuuucguuaaacugaauguggagacagauaccgccgaaauucgccucaugugcacagacaccuaucuggauacgcccagaccuaacgacgggagcaucacaggacccugugagucuaacggcgauaagggguccggaggcauuaaaggcggguuuguccaucaacggauggagagcaagaucggacgcugguacucuagaaccaugagcaaaaccgaacggaugggcauggggcuguaugugaaguacgacggagaccccugggcugauuccgacgcgcucgccuucucuggcgugauggucagcaugaaggagccugggugguacuccuuuggcuucgaaaucaaagauaagaaaugcgacguuccguguauuggaaucgagauggugcacgauggcgggaaggaaacauggcauagcgcugccaccgccauuuauugccugaugggaucuggccagcuucugugggacacagugacgggggucgauauggcucucuga

SEQ ID NO: 213281 - RNA, 1401 nt, Artificial Sequence; identical to SEQ ID NO: 213164
  derived and/or modified sequence opt5 from neuraminidase__InfluenzaB__AHL94948

SEQ ID NO: 213282 - RNA, 1401 nt, Artificial Sequence; identical to SEQ ID NO: 211980
  derived and/or modified sequence opt5 from neuraminidase__InfluenzaB__AHL94959

SEQ ID NO: 213283 - RNA, 1401 nt, Artificial Sequence; identical to SEQ ID NO: 211980
  derived and/or modified sequence opt5 from neuraminidase__InfluenzaB__AHL94969

SEQ ID NO: 213284 - RNA, 1401 nt, Artificial Sequence; identical to SEQ ID NO: 211980
  derived and/or modified sequence opt5 from neuraminidase__InfluenzaB__AHL94978

SEQ ID NO: 213285 - RNA, 1401 nt, Artificial Sequence
  derived and/or modified sequence opt5 from neuraminidase__InfluenzaB__AHM00990
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaaccacagcgcugccaaaggagugacccugcuucugcccgaaccugaguggacauaucccagacucuccuguccuggcagcaccuuccagaaggcccugcuuaucucuccccaucgguuuggggaaauuaaaggaaauuccgcuccucugaucauccgcgagccguucauugccugcggccccacggaauguaagcacuuugcucucacccauuacgccgcgcagccugggggauauuacaacggcacaagagaggaccggaauaaacugcgccaccugaucagcgucaagcucggcaagauucccaccguggagaacucuaucuuccauauggccgcuugguccgggagcgccugccacgauggaaaagaauggacauauauuggcguugacgggccugauucuaaugcucugcuuaagaucaaauacggagaggccuacaccgacacguaucacuccuacgcgaagaacauucugagaacacaagaaagcgccuguaauugcaucggcggggauuguuaucucaugaucaccgacggacccgcuuccggcgugucugagugccgguuucugaaaauucgcgagggcagaaucauuaaggaaaucuucccgacagggcgggucaagcauaccgaggaauguaccugcggauuugccagcaacaaaacaauugagugugcuugccgcgauaauagauacacggccaagcggccuuucgugaaacuuaacguugaaaccgacacagccgagauccgccugaugugcaccgagacauaucucgauacccccagaccuaaugacggcuccaucacggggcccugugaaagcgauggagacaagggcucugggggaauuaaaggcggcuuugugcaccagcggauggcuuccaagaucgggcgcugguacagcagaacaaugucuaaaaccaagcggaugggaaugggccuguaugucaaguacgacggggaucccuggaccgacagcgaggcgcuggcccucuccggagugauggugucuauggaggaaccuggcugguacagcuucggguuugaaauuaaagauaagaaaugcgacgucccguguaucggcauugagaugguucaugauggaggcaagacaaccuggcacuccgcugccacagccaucuauugccugauggggagcggacagcuucugugggacacggugaccggcguggauauggcucucuga

SEQ ID NO: 213286 - RNA, 1401 nt, Artificial Sequence; identical to SEQ ID NO: 213230
  derived and/or modified sequence opt5 from neuraminidase__InfluenzaB__AHM01001

SEQ ID NO: 213287 - RNA, 1401 nt, Artificial Sequence
  derived and/or modified sequence opt5 from neuraminidase__InfluenzaB__AHM01012
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccuggacagacagcgaugcucuggcguucuccggcgugauggucucuaugaaagaaccugggugguacagcuuuggcuucgagaucaaggacaaaaagugcgauguuccguguauuggaaucgaaauggugcacgacggcgggaaagagaccuggcauuccgccgcuacagccauuuauugccucaugggaagcggccagcugcuuugggauacggugaccggggucgacauggcccuguga

SEQ ID NO: 213288 - RNA, 1401 nt, Artificial Sequence; identical to SEQ ID NO: 213230
  derived and/or modified sequence opt5 from neuraminidase__InfluenzaB__AHM01023

SEQ ID NO: 213289 - RNA, 1401 nt, Artificial Sequence; identical to SEQ ID NO: 213230
  derived and/or modified sequence opt5 from neuraminidase__InfluenzaB__AHM01034

SEQ ID NO: 213290 - RNA, 1401 nt, Artificial Sequence
  derived and/or modified sequence opt5 from neuraminidase__InfluenzaB__AHM01045
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccggcuggaccuauccucggcucuccugucccgggagcacguuccagaaggcccugcuuauuucuccucaccgcuuuggagagaccaaaggcaauuccgcuccgcugaucauuagagaacccuucaucgccugcgggccuaacgaguguaagcauuuugcucucacacacuacgccgcgcagcccggaggcuauuacaauggcacccgcggggaccggaacaaacugagacaucugaucagcgucaagcucggaaagauuccuacaguggaaaauucuaucuuccacauggccgcuugguccggcagcgccugccaugaugggaaagaguggaccuauauuggaguugacggccccgauaacaaugcucugcuuaaggugaaauacggggaggccuacacggacacauaucacucuuacgcgaacaagauccugcggacccaggaauccgccuguaauugcauuggaggcaacuguuaucucaugaucacagauggcagcgcuuccggggucucugagugccgcuuucugaaaauuagagaaggacggaucaucaaggagauuuucccgaccggccgcgugaagcacaccgaggaauguacaugcggguuugccagcaauaaaacgaucgagugugcuugcagagacaaccgguacaccgccaagcgcccuuucguuaaacuuaauguggaaacagauaccgccgagauuagacugaugugcacagacaccuaucucgauacgccccggccuaacgacggauccaucacaggccccugugaaagcgauggggacaagggaucuggcggcauuaaagggggauuuguccaucaacgcaugaaguccaaaaucggcagaugguacagccggaccaugucuaagaccgagagaauggggaugggacuguaugugaaguacgacggcgaucccugggcugacagcgaugcgcuggccuucuccggggugauggucucuaugaaagagccuggcugguacagcuuuggauucgaaaucaaggacaaaaagugcgauguuccguguauuggcaucgagauggugcacgacgggggaaaagaaacauggcauuccgcugccaccgccauuuauugccucaugggcagcgggcagcugcuuugggauacaguggcuggagucgacauggcccuguga

SEQ ID NO: 213291 - RNA, 1401 nt, Artificial Sequence
  derived and/or modified sequence opt5 from neuraminidase__InfluenzaB__AHM01056
augcugcccagcaccacacagacgcucacccuguuccuuacauccggcggggugcugcucucucuguacgucagcgccucccuuucuuaucugcucuacagcgacauccugcugaaguuuuccccuaccgagauuacagcuccgaccaugccccucgauugcgccaacgcgucuaauguucaagcugugaacagaagcgccacaaaaggagugacccugcuucugccugaacccgaguggacguauccucggcucuccugucccggcagcaccuuccagaaggcccugcuuaucucuccucaccgcuuuggggaaacaaaaggaaauuccgcuccgcugauuaucagagagcccuucauugccugcggcccuaacgaauguaagcauuuugcucucacccacuacgccgcgcagcccgggggauauuacaauggcacacggggcgaccgcaacaaacugagacaucugaucagcgucaagcucgggaagaucccuaccguggaaaauucuauuuuccacauggccgcuugguccggaagcgccugccaugauggcaaagaguggacguauaucgggguugacggacccgauaacaaugcucugcuuaaggugaaauacggcgaggccuacacagacaccuaucacucuuacgcgaacaagauucugcggacacaggaguccgccuguaauugcaucgggggaaacuguuaucucaugauuaccgauggcagcgcuuccggcgucucugaaugccgcuuucugaaaaucagagaggggcggauuaucaaggagaucuucccgaccggacgcgugaagcacacagaagaguguacgugcggcuuugccagcaauaaaaccauugaaugugcuugcagagacaaccgguacacagccaagcgcccuuucguuaaacuuaauguggagaccgauacagccgaaaucagacugaugugcaccgacacguaucucgauacaccccggccuaacgacggguccauuaccggacccugugagagcgauggcgacaaggggucuggaggcaucaaaggcggguuuguccaucaacgcaugaaguccaaaauuggaagaugguacagccggaccaugucuaagacagagagaaugggcauggggcuguaugugaaguacgacggagaucccugggcugacagcgaugcgcugguguucuccggcgucaugguuucuaugaaagaaccugggugguacagcuuuggcuucgagaucaaggacaaaaagugcgaugugccguguaucggaauugaaauggugcacgacggcgggaaagagaccuggcauuccgccgcuacagccaucuauugccucaugggaagcggccagcugcuuugggauacggucaccgggguggacauggcccuguga

SEQ ID NO: 213292 - RNA, 1401 nt, Artificial Sequence; identical to SEQ ID NO: 213230
  derived and/or modified sequence opt5 from neuraminidase__InfluenzaB__AHM01067

SEQ ID NO: 213293 - RNA, 1401 nt, Artificial Sequence; identical to SEQ ID NO: 213199
  derived and/or modified sequence opt5 from neuraminidase__InfluenzaB__AHM01078

SEQ ID NO: 213294 - RNA, 1401 nt, Artificial Sequence
  derived and/or modified sequence opt5 from neuraminidase__InfluenzaB__AHM01089
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccgccaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcgugaagcacaccgaagaguguaccugcggcuuugcuagcaauaaaacaaucgaaugugccugcagagacaaccgguacacggccaagcgcccuuucguuaaacuuaauguggagaccgauacagcugaaauuagacugaugugcaccgacacauaucucgauacgccccggccuaacgacggguccaucaccggacccugugagagcgauggcgacaaggggucuggaggcauuaaaggcggguuuguccaucaacgcaugaaguccaaaaucggaagaugguacagccggacaaugucuaagaccgagagaaugggcauggggcuguaugugaaguacgacggagaucccugggcggacagcgaugcccuggcuuucuccggcgugauggucucuaugaaagaaccugggugguacagcuuuggcuucgagaucaaggacaaaaagugcgauguuccguguauuggaaucgaaauggugcacgacggcgggaaagagaccuggcauuccgccgccacagcuauuuauugccucaugggaagcggccagcugcuuugggauaccgugacaggggucgacauggcccuguga

SEQ ID NO: 213295 - RNA, 1401 nt, Artificial Sequence; identical to SEQ ID NO: 213199
  derived and/or modified sequence opt5 from neuraminidase__InfluenzaB__AHM01100

SEQ ID NO: 213296 - RNA, 1401 nt, Artificial Sequence; identical to SEQ ID NO: 213230
  derived and/or modified sequence opt5 from neuraminidase__InfluenzaB__AHM01111

SEQ ID NO: 213297 - RNA, 1401 nt, Artificial Sequence
  derived and/or modified sequence opt5 from neuraminidase__InfluenzaB__AHM01122
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugaagcugcuucugccugaacccgaguggacauauccucggcucuccugucccggcagcaccuuccagaaagcccugcuuauuucuccucaccgcuuuggggaaacgaagggaaauuccgcuccgcugaucauuagagagcccuucaucgccugcggcccuaacgaauguaaacauuuugcucucacccacuacgccgcgcagcccgggggauauuacaauggcacacggggcgaccgcaacaagcugagacaucugaucagcgucaagcucgggaaaauuccuaccguggaaaauucuaucuuccacauggccgcuugguccggaagcgccugccaugauggcaaggaguggacauauauugggguugacggacccgauaacaaugcucugcuuaaagugaaguacggcgaggccuacaccgacacguaucacucuuacgcgaacaaaauccugcggacacaggaguccgccuguaauugcauugggggaaacuguuaucucaugaucaccgauggcagcgcuuccggcgucucugaaugccgcuuucugaagauuagagaggggcggaucaucaaggagauuuucccgacaggacgcgugaaacacaccgaagaguguaccugcggcuuugccagcaauaagacaaucgaaugugcuugcagagacaaccgguacacggccaaacgcccuuucguuaaacuuaauguggagaccgauacagccgaaauuagacugaugugcaccgacacauaucucgauacgccccggccuaacgacggguccaucaccggacccugugagagcgauggcgacaaggggucuggaggcauuaagggcggguuuguccaucaacgcaugaaauccaagaucggaagaugguacagccggacaaugucuaagaccgagagaaugggcauggggcuguaugugaaauacgacggagaucccugggcugacagcgaugcgcuggccuucuccggcgugauggucucuaugaaggaaccugggugguacagcuuuggcuucgagaucaaagacaagaaaugcgauguuccguguauuggaaucgaaauggugcacgacggcgggaaggagaccuggcauuccgcugccacagccauuuauugccucaugggaagcggccagcugcuuugggauaccgugacaggggucgacauggcucuguga

SEQ ID NO: 213298 - RNA, 1401 nt, Artificial Sequence; identical to SEQ ID NO: 213230
  derived and/or modified sequence opt5 from neuraminidase__InfluenzaB__AHM01133

SEQ ID NO: 213299 - RNA, 1401 nt, Artificial Sequence
  derived and/or modified sequence opt5 from neuraminidase__InfluenzaB__AHM01144
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccgccaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcauuucugaaugccgcuuucugaaaaucagagaggggcggaucauuaaggagaucuucccgacaggacgcgucaagcacaccgaagaguguaccugcggcuuugcuagcaauaaaacaauugaaugugccugcagagacaaccgguacacggccaagcgcccuuucgugaaacuuaauguugagaccgauacagcugaaaucagacugaugugcaccgacacauaucucgauacgccccggccuaacgacggguccauuaccggacccugugagagcgauggcgacaaggggucuggaggcaucaaaggcggguuugugcaucaacgcaugaaguccaaaaucggaagaugguacagccggacaaugucuaagaccgagagaaugggcauggggcuguaugucaaguacgacggagaucccugggcggacagcgaugcccuggcuuucuccggcgugauggugucuaugaaagaaccugggugguacagcuuuggcuucgagauuaaggacaaaaagugcgaugucccguguaucggaauugaaaugguucacgacggcgggaaagagaccuggcauuccgccgccacagcuaucuauugccucaugggaagcggccagcugcuuugggauaccgugacagggguggacauggcccuguga

SEQ ID NO: 213300 - RNA, 1401 nt, Artificial Sequence; identical to SEQ ID NO: 213230
  derived and/or modified sequence opt5 from neuraminidase__InfluenzaB__AHM01166

SEQ ID NO: 213301 - RNA, 1401 nt, Artificial Sequence
  derived and/or modified sequence opt5 from neuraminidase__InfluenzaB__AHM01188
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaaccacagcgccaccaaaggagugacacugcuucugccugaacccgaguggaccuauccuagacucuccugucccggcagcacguuccagaaggcccugcuuauuucuccucaucgguuuggggaaaccaaaggaaauuccgcuccgcugaucauucgcgagcccuucaucgccugcggcccuaacgaauguaagcacuuugcucucacacauuacgccgcgcagcccgggggauauuacaauggcaccagaggcgaccggaacaaacugcgccaccugaucagcgucaagcucgggaagauuccuacaguggaaaauucuaucuuccauauggccgcuugguccggaagcgccugccacgauggcaaagaguggaccuauauugggguugacggacccgauaacaaugcucugcuuaaggugaaauacggcgaggccuacacggacacauaucacucuuacgcgaacaagauccugagaacccaggaguccgccuguaauugcauugggggaaacuguuaucucaugaucacagauggcagcgcuuccggcgucucugaaugccgguuucugaaaauucgcgaggggagaaucaucaaggagauuuucccgaccggacgggugaagcauaccgaagaguguacaugcggcuuugccagcaauaaaacgaucgaaugugcuugccgcgacaacagauacaccgccaagcggccuuucguuaaacuuaauguggagacagauaccgccgaaauucgccugaugugcacagacaccuaucucgauacgcccagaccuaacgacggguccaucacaggacccugugagagcgauggcgacaaggggucuggaggcauuaaaggcggguuuguccaccaacggaugaaguccaaaaucggacgcugguacagcagaaccaugucuaagaccgagcggaugggcauggggcuguaugugaaguacgacggagaucccugggcugacagcgaugcgcugguguucuccggcgucaugguuucuaugaaagaaccugggugguacagcuuuggcuucgagaucaaggacaaaaagugcgaugugccguguauuggaaucgaaauggugcaugacggcgggaaagagacauggcacuccgccgcuaccgccauuuauugccucaugggaagcggccagcugcuuugggauacagucacggggguggacauggcccuguga

SEQ ID NO: 213302 - RNA, 1401 nt, Artificial Sequence; identical to SEQ ID NO: 213294
  derived and/or modified sequence opt5 from neuraminidase__InfluenzaB__AHM01199

SEQ ID NO: 213303 - RNA, 1401 nt, Artificial Sequence
  derived and/or modified sequence opt5 from neuraminidase__InfluenzaB__AHM01210
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccggcuggaccuauccucggcucuccugucccgggagcacguuccagaaggcccugcuuauuucuccucaccgcuuuggagaggcuaaaggcaauuccgccccgcugaucauuagagaacccuucaucgcuugcgggccuaacgaguguaagcauuuugcccucacccacuacgcggcccagcccggaggcuauuacaauggcacacgcggggaccggaacaaacugagacaucugaucagcgucaagcucggaaagauuccuaccguggaaaauucuaucuuccacauggcugccugguccggcagcgcuugccaugaugggaaagaguggacauauauuggaguugacggccccgauaacaaugcccugcuuaaggugaaauacggggaggcguacaccgacacguaucacucuuacgccaacaagauccugcggacacaggaauccgcuuguaauugcauuggaggcaacuguuaucucaugaucaccgauggcagcgccuccggggucucugagugccgcuuucugaaaauuagagaaggacggaucaucaaggagauuuucccgacaggccgcgugaagcacaccgaggaauguaccugcggguuugcuagcaauaaaacaaucgagugugccugcagagacaaccgguacacggccaagcgcccuuucguuaaacuuaauguggaaaccgauacagcugagauuagacugaugugcaccgacacauaucucgauacgccccggccuaacgacggauccaucaccggccccugugaaagcgauggggacaagggaucuggcggcauuaaagggggauuuguccaucaacgcaugaaguccaaaaucggcagaugguacagccggacaaugucuaagaccgagagaauggggaugggacuguaugugaaguacgacggcgaucccugggcggacagcgaugcccuggcuuucuccggggugauggucucuaugaaagagccuggcugguacagcuuuggauucgaaaucaaggacaaaaagugcgauguuccguguauuggcaucgagauggugcacgacgggggaaaagaaaccuggcauuccgccgccacagcuauuuauugccucaugggcagcgggcagcugcuuugggauaccguggccggagucgacauggcgcuguga

SEQ ID NO: 213304 - RNA, 1401 nt, Artificial Sequence
  derived and/or modified sequence opt5 from neuraminidase__InfluenzaB__AHM01221
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauuuccaagcuguuaacagaagcgccaccaaaggagugacauuucugcuuccugaacccgaguggaccuauccucggcuguccugucccggcagcacguuccagaaggcccuccugauuucuccucaccgcuuuggggaaaccaaaggaaauuccgcuccgcuuaucauuagagagcccuucaucgccugcggcccuaacgaauguaagcauuuugcucugacacacuacgccgcgcagcccgggggauauuacaauggcacccggggcgaccgcaacaaacucagacaucugaucagcgugaagcuggggaagauuccuacagucgaaaauucuaucuuccacauggccgcuugguccggaagcgccugccaugauggcaaagaguggaccuauauugggguggacggacccgauaacaaugcucuccugaagguuaaauacggcgaggccuacacggacacauaucacucuuacgcgaacaagauccuucggacccaggaguccgccuguaauugcauugggggaaacuguuaucugaugaucacagauggcagcgcuuccggcgugucugaaugccgcuuucucaaaauuagagaggggcggaucaucaaggagauuuucccgaccggacgcgucaagcacaccgaagaguguacaugcggcuuugccagcaauaaaacgaucgaaugugcuugcagagacaaccgguacaccgccaagcgcccuuucgugaaacugaauguugagacagauaccgccgaaauuagacuuaugugcacagacaccuaucuggauacgccccggccuaacgacggguccaucacaggacccugugagagcgauggcgacaaggggucuggaggcauuaaaggcggguuugugcaucaacgcaugaaguccaaaaucggaagaugguacagccggaccaugucuaagaccgagagaaugggcauggggcucuaugucaaguacgacggagaucccugggcugacagcgaugcgcuggccuucuccggcgugauggugucuaugaaagaaccugggugguacagcuucggcuuugagaucaaggacaaaaagugcgaugucccguguauuggaaucgaaaugguucacgacggcgggaaagagacauggcauuccgcugccaccgccauuuauugccugaugggaagcggccagcuccugugggauacagugacggggguggacauggcucuuuga

SEQ ID NO: 213305 - RNA, 1401 nt, Artificial Sequence; identical to SEQ ID NO: 213199
  derived and/or modified sequence opt5 from neuraminidase__InfluenzaB__AHM01232

SEQ ID NO: 213306 - RNA, 1401 nt, Artificial Sequence; identical to SEQ ID NO: 213230
  derived and/or modified sequence opt5 from neuraminidase__InfluenzaB__AHM01243

SEQ ID NO: 213307 - RNA, 1401 nt, Artificial Sequence
  derived and/or modified sequence opt5 from neuraminidase__InfluenzaB__AHM01254
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccugggcugacagcgaugcgcugguguucuccggcgucaugguuucuaugaaagaaccugggugguacagcuuuggcuucgagaucaaggacaaaaagugcgaugugccguguauuggaaucgaaauggugcacgacggcgggaaagagacauggcauuccgccgcuaccgccauuuauugccucaugggaagcggccagcugcuuugggauacagucacggggguggacauggcccuguga

SEQ ID NO: 213308 - RNA, 1401 nt, Artificial Sequence
  derived and/or modified sequence opt5 from neuraminidase__InfluenzaB__AHM01265
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacgaggggucuggaggcauuaagggcggguuuguccaucaacgcaugaaauccaagaucggaagaugguacagccggaccaugucuaaaaccgaaagaaugggcauggggcuguaugugaaguacgacggagaucccugggcugacagcgaugcgcuggccuucuccggcgugauggucucuaugaaggagccugggugguacagcuuuggcuucgaaaucaaagacaagaaaugcgauguuccguguauuggaaucgagauggugcacgacggcgggaaggaaacauggcauuccgcugccaccgccauuuauugccucaugggaagcggccgccugcuuugggauacagugacgggggucgacauggcucuguga

SEQ ID NO: 213309 - RNA, 1401 nt, Artificial Sequence
  derived and/or modified sequence opt5 from neuraminidase__InfluenzaB__AHM01276
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaauuaaaggaaauuccgcuccucugaucaucagagagccguucauugccugcggccccacggaauguaagcauuuugcucucacccacuacgccgcgcagccugggggauauuacaacggcacacgggaggaccgcaauaaacugagacaucugaucagcgucaagcucggcaagauucccaccguggagaacucuaucuuccacauggccgcuugguccgggagcgccugccaugauggaaaagaauggacauauauuggcguugacgggccugauucuaaugcucugcuuaagaucaaauacggagaggccuacaccgacacguaucacuccuacgcgaagaacauucugcggacacaagaaagcgccuguaauugcaucggcggggauuguuaucucaugaucaccgacggacccgcuuccggcgugucugagugccgcuuucugaaaauuagagagggccggaucauuaaggaaaucuucccgacagggcgcgucaagcacaccgaggaauguaccugcggauuugccagcaacaaaacaauugagugugcuugcagagauaaucgguacacggccaagcgcccuuucgugaaacuuaacguugaaaccgacacagccgagaucagacugaugugcaccgagacauaucucgauacgccccggccuaaugacggcuccaucaccgggcccugugaaagcgauggagacaagggcucugggggaauuaaaggcggcuuugugcaucagcgcauggcuuccaagaucgggagaugguacagccggacaaugucuaaaaccaagagaaugggaaugggccuguaugucaaguacgacggggaucccuggaccgacagcgaggcgcuggcccucuccggagugauggugucuauggaggaaccuggcugguacagcuucggguuugaaauuaaagauaagaaaugcgacgucccguguaucggcauugagaugguucacgauggaggcaagacaaccuggcauuccgcugccacagccaucuauugccugauggggagcggacagcuucugugggacacggugaccggcguggauauggcucucuga

SEQ ID NO: 213310 - RNA, 1401 nt, Artificial Sequence; identical to SEQ ID NO: 213294
  derived and/or modified sequence opt5 from neuraminidase__InfluenzaB__AHM01287

SEQ ID NO: 213311 - RNA, 1401 nt, Artificial Sequence; identical to SEQ ID NO: 213294
  derived and/or modified sequence opt5 from neuraminidase__InfluenzaB__AHM01298

SEQ ID NO: 213312 - RNA, 1401 nt, Artificial Sequence; identical to SEQ ID NO: 213309
  derived and/or modified sequence opt5 from neuraminidase__InfluenzaB__AHM01309

SEQ ID NO: 213313 - RNA, 1401 nt, Artificial Sequence; identical to SEQ ID NO: 213230
  derived and/or modified sequence opt5 from neuraminidase__InfluenzaB__AHM01320

SEQ ID NO: 213314 - RNA, 1401 nt, Artificial Sequence; identical to SEQ ID NO: 213294
  derived and/or modified sequence opt5 from neuraminidase__InfluenzaB__AHM01331

SEQ ID NO: 213315 - RNA, 1401 nt, Artificial Sequence; identical to SEQ ID NO: 213230
  derived and/or modified sequence opt5 from neuraminidase__InfluenzaB__AHM01342

SEQ ID NO: 213316 - RNA, 1401 nt, Artificial Sequence
  derived and/or modified sequence opt5 from neuraminidase__InfluenzaB__AHM01353
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccggcuggaccuauccucggcucuccugucccgggagcacguuccagaaggcccugcuuauuucuccucaccgcuuuggagagaccaaaggcaauuccgcuccgcugaucauuagagaacccuucaucgccugcgggccuaacgaguguaagcauuuugcucucacacacuacgccgcgcagcccggaggcuauuacaauggcacccgcggggaccggaacaaacugagacaucugaucagcgucaagcucggaaagauuccuacaguggaaaauucuaucuuccacauggccgcuugguccggcagcgccugccaugaugggaaagaguggaccuauauuggaguugacggccccgauaacaaugcucugcuuaaggugaaauacggggaggccuacacggacacauaucacucuuacgcgaacaagauccugcggacccaggaauccgccuguaauugcauuggaggcaacuguuaucucaugaucacagauggcagcgcuuccggggucucugagugccgcuuucugaaaauuagagaaggacggaucaucaaggagauuuucccgaccggccgcgugaagcacaccgaggaauguacaugcggguuugccagcaauaaaacgaucgagugugcuugcagagacaaccgguacaccgccaagcgcccuuucguuaaacuuaauguggaaacagauaccgccgagauuagacugaugugcacagacaccuaucucgauacgccccggccuaacgacggauccaucacaggccccugugaaagcgauggggacaagggaucuggcggcauuaaagggggauuuguccaucaacgcaugaaguccaaaaucggcagaugguacagccggaccaugucuaagaccgagagaauggggaugggacuguaugugaaguacgacggcgaucccugggcugacagcgaugcgcuggccuucuccggggugauggucucuaugaaagagccuggcugguacagcuuuggauucgaaaucaaggacaaaaagugcgauguuccguguauuggcaucgagauggugcacgacgggggaaaagaaacauggcauuccgcugccaccgccauuuauugccucaugggcagcgggcagcugcuuugggauacagugacgggagucgacauggcucuguga

SEQ ID NO: 213317 - RNA, 1401 nt, Artificial Sequence
  derived and/or modified sequence opt5 from neuraminidase__InfluenzaB__AHM01364
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacgaggggucuggaggcauuaagggcggguuuguccaucaacgcaugaaauccaagaucggaagaugguacagccggaccaugucuaaaaccgaaagaaugggcauggggcuguaugugaaguacgacggagaucccugggcugacagcgaugcgcuggccuucuccggcgugauggucucuaugaaggagccugggugguacagcuuuggcuucgaaaucaaagacaagaaaugcgauguuccguguauuggaaucgagauggugcacgacggcgggaaggaaacauggcauuccgcugccaccgccauuuauugccucaugggaagcggccagcugcuuugggauacagugacgggggucgacauggcucuguga

SEQ ID NO: 213318 - RNA, 1401 nt, Artificial Sequence; identical to SEQ ID NO: 213309
  derived and/or modified sequence opt5 from neuraminidase__InfluenzaB__AHM01375

SEQ ID NO: 213319 - RNA, 1401 nt, Artificial Sequence; identical to SEQ ID NO: 213309
  derived and/or modified sequence opt5 from neuraminidase__InfluenzaB__AHM01386

SEQ ID NO: 213320 - RNA, 1401 nt, Artificial Sequence; identical to SEQ ID NO: 213230
  derived and/or modified sequence opt5 from neuraminidase__InfluenzaB__AHM01397

SEQ ID NO: 213321 - RNA, 1401 nt, Artificial Sequence; identical to SEQ ID NO: 213230
  derived and/or modified sequence opt5 from neuraminidase__InfluenzaB__AHM01408

SEQ ID NO: 213322 - RNA, 1401 nt, Artificial Sequence; identical to SEQ ID NO: 213230
  derived and/or modified sequence opt5 from neuraminidase__InfluenzaB__AHM01419

SEQ ID NO: 213323 - RNA, 1401 nt, Artificial Sequence
  derived and/or modified sequence opt5 from neuraminidase__InfluenzaB__AHM01430
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacgaggggucuggaggcauuaagggcggguuuguccaucaacgcaugaaauccaagaucggaagaugguacagccggaccaugucuaaaaccgaaagaaugggcauggggcuguaugugaaguacgacggagaucccugggcugacagcgaugcgcuggccuucuccggcgugauggucucuaugaaggagccugggugguacagcuuuggcuucgaaaucaaagacaagaaaugcgauguuccguguauuggaaucgagauggugcacgacggcgggaaggaaacauggcauuccgcugccaccgccauuuauugccucaugggaagcggccgccugcuuugggauacagcuacggggguggacauggcccuguga

SEQ ID NO: 213324 - RNA, 1401 nt, Artificial Sequence
  derived and/or modified sequence opt5 from neuraminidase__InfluenzaB__AHM01441
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuacaaugccgcucgauugcgccaacgcgucuaauguucaggcugugaacagaagcgccgccaaaggagugacccugcuucugcccgaaccugaguggacauauccccggcucuccuguccuggcagcaccuuccagaaggcucugcuuauuucuccccaccgcuuuggggaaaucaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcgugucugagugccgcuuucugaaaaucagagagggccggauuaucaaggaaauuuucccgacagggcgcgucaagcacaccgaggaauguaccugcggauuugcuagcaacaaaacaaucgagugugccugcagagauaaucgguacacggccaagcgcccuuucgugaaacuuaacguugaaaccgacacagcugagauuagacugaugugcaccgagacauaucucgauacgccccggccuaaugacggcuccaucaccgggcccugugaaagcgauggagacaagggcucugggggaaucaaaggcggcuuugugcaucagcgcauggcguccaagauugggagaugguacagccggacaaugucuaaaaccaagagaaugggaaugggccuguaugucaaguacgacggggaucccuggaccgacagcgaggcccuggcucucuccggagugauggugucuauggaggaaccuggcugguacagcuucggguuugaaaucaaagauaagaaaugcgacgucccguguauuggcaucgagaugguucacgauggaggcaagacaaccuggcauuccgccgccacagcuauuuauugccugauggggagcggacagcuucugugggacacggugaccggcguggauauggcccucuga

SEQ ID NO: 213325 - RNA, 1401 nt, Artificial Sequence; identical to SEQ ID NO: 213230
  derived and/or modified sequence opt5 from neuraminidase__InfluenzaB__AHM01463

SEQ ID NO: 213326 - RNA, 1401 nt, Artificial Sequence
  derived and/or modified sequence opt5 from neuraminidase__InfluenzaB__AHM01474
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcaucaacgccucuaauguucaggcggugaacagaagcgcugccaaaggagugacacugcuucugcccgaaccugaguggaccuauccccggcucuccuguccuggcagcacauuccagaaggcccugcuuauuucuccccaccgcuuuggggaaaucaaaggaaauuccgcuccucugaucauuagagagccguucaucgccugcggccccaccgaauguaagcauuuugcucucacgcacuacgccgcgcagccugggggauauuacaacggcacccgggaggaccgcaauaaacugagacaucugauuagcgucaagcucggcaagauccccacaguggagaacucuauuuuccacauggccgcuugguccgggagcgccugccaugauggaaaagaauggaccuauaucggcguugacgggccugauucuaaugcucugcuuaagauuaaauacggagaggccuacacagacaccuaucacuccuacgcgaagaacauccugcggacgcaagaaagcgccuguaauugcaucggcggggauuguuaucucaugauuacagacggacccgcuuccggcgugucugagugccgcuuucugaaaaucagagagggccggauuaucaaggaaauuuucccgaccgggcgcgucaagcacacagaggaauguaccugcggauuugccagcaacaaaaccaucgagugugcuugcagagauaaucgguacacagccaagcgcccuuucgugaaacuuaacguugaaacggacaccgccgagaucagacugaugugcacagagaccuaucucgauacaccccggccuaaugacggcuccauuaccgggcccugugaaagcgauggagacaagggcucugggggaaucaaaggcggcuuugugcaucagcgcauggcuuccaagauugggagaugguacagccggacgaugucuaaaacaaagagaaugggaaugggccuguaugucaaguacgacggggaucccuggaccgacagcgaggcgcuggcccucuccggagugauggugucuauggaggaaccuggcugguacagcuucggguuugaaaucaaagauaagaaaugcgacgucccguguauuggcaucgagaugguucacgauggaggcaagaccacauggcauuccgcugccaccgccaucuauugccugauggggagcggacagcuucugugggacacagugacgggcguggauauggcucucuga

SEQ ID NO: 213327 - RNA, 1401 nt, Artificial Sequence
  derived and/or modified sequence opt5 from neuraminidase__InfluenzaB__AHM01485
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgauuaugccccucgauugcacaaacgccucuaauguucaagcggugaacagaagcgcugccaaaggagugacccugcuucugccugaacccgaguggacauauccucggcucuccugucccggcagcaccuuccagaaggcccugcuuaucucuccucaccgcuuuggggaaauuaaaggaaauuccgcuccgcugaucaucagagagcccuucauugccugcggcccuacggaauguaagcauuuugcucucacccacuacgccgcgcagcccgggggauauuacaacggcacacgggaggaccgcaauaaacugagacaucugaucagcgucaagcucggcaagauuccuaccguggagaacucuaucuuccacauggccgcuugguccgggagcgccugccaugauggaaaagaauggacauauauuggcguugacgggcccgauucuaaugcucugcuuaagaucaaauacggagaggccuacaccgacacguaucacuccuacgcgaagaacauucugcggacacaggaaagcgccuguaauugcaucggcggggauuguuaucucaugaucaccgacggaccggcuuccggcgugucugagugccgcuuucugaaaauuagagagggccggaucauuaaggaaaucuucccuacagggcgcgucaagcacaccgaggaauguaccugcggauuugccagcaacaaaacaauugagugugcuugcagagauaaucgguacacggccaagcgccccuucgugaaacuuaacguugaaaccgacacagccgagaucagacugaugugcaccgagacauaucucgauaccccucggcccaaugacggcuccaucacggggcccugugaaagcgauggagacaagggcucugggggaauuaaaggcggcuuugugcaucaacgcauggcuuccaagaucgggagaugguacagccggacaaugucuaaaaccaagagaaugggaaugggccuguaugucaaguacgacggggauccuuggaccgacagcgaggcgcuggcccucuccggagugauggugucuauggaggaaccgggcugguacagcuucggguuugaaauuaaagauaagaaaugcgacguccccuguaucggcauugagaugguucacgauggaggcaagacaaccuggcauuccgcugccacagccaucuauugccugauggggagcggacagcuucugugggacacggugaccggcguggauauggcucucuga

SEQ ID NO: 213328 - RNA, 1401 nt, Artificial Sequence; identical to SEQ ID NO: 213309
  derived and/or modified sequence opt5 from neuraminidase__InfluenzaB__AHM01496

SEQ ID NO: 213329 - RNA, 1401 nt, Artificial Sequence
  derived and/or modified sequence opt5 from neuraminidase__InfluenzaB__AHM01507
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaauuaaaggaaauuccgccccucugaucgucagagagccguucaucgcuugcggccccaccgaauguaagcauuuugcccucacgcacuacgcggcccagccugggggauauuacaacggcacccgggaggaccgcaauaaacugagacaucugauuagcgugaagcucggcaagauccccacaguugagaacucuauuuuccacauggcugccugguccgggagcgcuugccaugauggaaaagaauggaccuauaucggcguggacgggccugauucuaaugcccugcuuaagauuaaauacggagaggcguacacagacaccuaucacuccuacgccaagaacauccugcggacgcaagaaagcgcuuguaauugcauuggcggggauuguuaucucaugaucacagacggacccgccuccggcgucucugagugccgcuuucugaaaaucagagagggccggauuaucaaggaaauuuucccgaccgggcgcgugaagcacacagaggaauguaccugcggauuugcuagcaacaaaaccaucgagugugccugcagagauaaucgguacacagccaagcgcccuuucguuaaacuuaacguggaaacggacaccgcugagauuagacugaugugcacagagaccuaucucgauacaccccggccuaaugacggcuccaucaccgggcccugugaaagcgauggagacaagggcucugggggaaucaaaggcggcuuuguccaucagcgcauggcguccaagauugggagaugguacagccggacgaugucuaaaacaaagagaaugggaaugggccuguaugugaaguacgacggggaucccuggaccgacagcgaggcccuggcucucuccggagugauggucucuaucgaggaaccuggcugguacagcuucggguuugaaauuaaagauaagaaaugcgacguuccguguaucggcauugagauggugcacgauggaggcaagaccacauggcauuccgccgccaccgcuaucuauugccugauggggagcggacagcuucugugggacacagugacgggcgucgauauggcccucuga

SEQ ID NO: 213330 - RNA, 1401 nt, Artificial Sequence; identical to SEQ ID NO: 213309
  derived and/or modified sequence opt5 from neuraminidase__InfluenzaB__AHM01518

SEQ ID NO: 213331 - RNA, 1401 nt, Artificial Sequence
  derived and/or modified sequence opt5 from neuraminidase__InfluenzaB__AHM01529
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaauuaaaggaaauuccgcuccucugaucaucagagagccguucauugccugcggccccacggaauguaagcauuuugcucucacccacuacgccgcgcagccugggggauauuacaacggcacacgggaggaccgcaauaaacugagacaucugaucagcgucaagcucggcaagauucccaccguggagaacucuaucuuccacauggccgcuugguccgggagcgccugccaugauggaaaagaauggacauauauuggcguugacgggccugauucuaaugcucugcuuaagaucaaauacggagaggccuacaccgacacguaucacuccuacgcgaagaacauucugcggacacaagaaagcgccuguaauugcaucggcggggauuguuaucucaugaucaccgacggacccgcuuccggcgugucugagugccgcuuucugaaaauuagagagggccggaucauuaaggaaauccuuccgacagggcgcgucaagcacaccgaggaauguaccugcggauucgccagcaacaaaacaauugagugugcuugcagagauaaucgguacacggccaagcgcccuuuugugaaacugaacguugaaaccgacacagccgagaucagacucaugugcaccgagacauaucuggauacgccccggccuaaugacggcuccaucaccgggcccugugaaagcgauggagacaagggcucugggggaauuaaaggcggcuucgugcaucagcgcauggcuuccaagaucgggagaugguacagccggacaaugucuaaaaccaagagaaugggaaugggccuguaugucaaguacgacggggaucccuggaccgacagcgaggcgcucgcccuguccggagugauggugucuauggaggaaccuggcugguacagcuuuggguucgaaauuaaagauaagaaaugcgacgucccguguaucggcauugagaugguucacgauggaggcaagacaaccuggcauuccgcugccacagccaucuauugccuuauggggagcggacagcugcucugggacacggugaccggcguggauauggcucuguga

SEQ ID NO: 213332 - RNA, 1401 nt, Artificial Sequence; identical to SEQ ID NO: 213199
  derived and/or modified sequence opt5 from neuraminidase__InfluenzaB__AHM01540

SEQ ID NO: 213333 - RNA, 1401 nt, Artificial Sequence; identical to SEQ ID NO: 213309
  derived and/or modified sequence opt5 from neuraminidase__InfluenzaB__AHM01551

SEQ ID NO: 213334 - RNA, 1401 nt, Artificial Sequence; identical to SEQ ID NO: 213309
  derived and/or modified sequence opt5 from neuraminidase__InfluenzaB__AHM01562

SEQ ID NO: 213335 - RNA, 1401 nt, Artificial Sequence; identical to SEQ ID NO: 211816
  derived and/or modified sequence opt5 from neuraminidase__InfluenzaB__AHZ13597

SEQ ID NO: 213336 - RNA, 1404 nt, Artificial Sequence
  derived and/or modified sequence opt5 from neuraminidase__InfluenzaB__AHZ36701
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuucugccugaacccgaguggacauauccucggcucuccugucccggcagcaccuuucaaaaggcccugcuuauuucuccucaucgcuucggggaaacgaaaggaaauuccgcuccgcugaucauuagagagcccuuuaucgccugcggcccuaacgaauguaagcacuucgcucucacccauuacgccgcgcagcccgggggauauuacaauggcacacggggcgaccgcaacaaacugagacaccugaucagcgucaagcucgggaagauuccuaccguggaaaauucuaucuuucauauggccgcuugguccggaagcgccugccacgauggcaaagaguggacauauauugggguugacggacccgauaacaaugcucugcuuaagaucaaauacggcgaggccuacaccgacacguaucacucuuacgcgaacaauauucugcggacacaggaguccgccuguaacugcaucgggggaaauuguuaucucaugauuaccgauggcagcgcuuccggcgugucugaaugccgcuuccugaagaucagaaaagggcggaucauuaaggagaucuuuccgacaggacgcgucaagcauaccgaggaauguaccugcggcuucgccagcaacaaaacaauugagugugcuugcagagacaauuccuacacggccaagcggccuuuugugaaacuuaacguugaaaccgauacagccgagauccgccugaugugcaccgacacauaucucgauacccccagaccugacgaugggagcauuacgggacccugugaaucuaacggcgacaagggguccggaggcaucaaaggcggguucgugcaccagcggauggcuagcaagaucggacgcugguacucuagaacaaugagcaaaaccgagcggaugggcauggggcuguaugucaaguacgacggagaucccuggaccgacuccgaugcgcuggccuuuagaggcgugauggugucuaugaaggagccugggugguacagcuucggcuucgaaauuaaagacaagaaaugcgaugucccguguaucggaauugagaugguucaugacggcgggaaggaaacauggcacuccgcugccaccgccaucuauugccucaugggaagcggccaacugcuuugggauacagugacggggguggacauggcucuguga

SEQ ID NO: 213337 - RNA, 1404 nt, Artificial Sequence
  derived and/or modified sequence opt5 from neuraminidase__InfluenzaB__AHZ36756
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuucugccugaacccgaguggacauauccucggcucuccugucccggcagcaccuuucaaaaggcccugcuuauuucuccucaucgcuucggggaaacgaaaggaaauuccgcuccgcugaucauuagagagcccuuuaucgccugcggcccuaacgaauguaagcacuucgcucucacccauuacgccgcgcagcccgggggauauuacaauggcacacggggcgaccgcaacaaacugagacaccugaucagcgucaagcucgggaagauuccuaccguggaaaauucuaucuuucauauggccgcuugguccggaagcgccugccacgauggcaaagaguggacauauauugggguugacggacccgauaacaaugcucugcuuaagaucaaauacggcgaggccuacaccgacacguaucacucuuacgcgaacaauauucugcggacacaggaguccgccuguaacugcaucgggggaaauuguuaucucaugauuaccgauggcagcgcuuccggcgugucugaaugccgcuuccugaagaucagagaggggcggaucauuaaagagaucuuuccgacaggacgcgucaagcauaccgaagaguguaccugcggcuucgccagcaacaagacaauugaaugugcuugcagagacaauuccuacacggccaaacggccuuuugugaaacuuaacguugagaccgauacagccgaaauccgccugaugugcaccgacacauaucucgauacccccagaccugacgaugggagcauuacgggacccugugagucuaacggcgacaagggguccggaggcaucaagggcggguucgugcaccagcggauggcuagcaaaaucggacgcugguacucuagaacaaugagcaagaccgagcggaugggcauggggcuguaugucaaauacgacggagaucccuggaccgacuccgaugcgcuggccuuuagaggcgugauggugucuaugaaggaaccugggugguacagcuucggcuucgagauuaaggacaaaaagugcgaugucccguguaucggaauugaaaugguucaugacggcgggaaagagacauggcacuccgcugccaccgccaucuauugccucaugggaagcggccaacugcuuugggauacagugacggggguggacauggcucuguga

SEQ ID NO: 213338 - RNA, 1401 nt, Artificial Sequence
  derived and/or modified sequence opt5 from neuraminidase__InfluenzaB__AHZ36767
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaagaccccucgauugcgccaacgcgucuaauguucaagcugugaaccggagcgccaccaaaggagugacacugcuucugccugaacccgaguggaccuauccucgccucuccugucccggcagcacguuccagaaggcccugcuuauuucuccucacagauuuggggaaaccaaaggaaauuccgcuccgcugaucauucgggagcccuucaucgccugcggcccuaacgaauguaagcauuuugcucucacacacuacgccgcgcagcccgggggauauuacaauggcacccgcggcgacagaaacaaacugcggcaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcgcacccaggaguccgccuguaauugcauugggggaaacuguuaucucaugaucacagauggcagcgcuuccggcgucucugaaugcagauuucugaaaauucgggaggggcgcaucaucaaggagauuuucccgaccggaagagugaagcacaccgaagaguguacaugcggcuuugccagcaauaaaacgaucgaaugugcuugccgggacaaccgcuacaccgccaagagaccuuucguuaaacuuaauguggagacagauaccgccgaaauucggcugaugugcacagacaccuaucucgauacgccccgcccuaacgacggguccaucacaggacccugugagagcgauggcgacaaggggucuggaggcauuaaaggcggguuuguccaucaaagaaugaaguccaaaaucggacggugguacagcagaaccaugucuaagaccgagcgcaugggcauggggcuguaugugaaguacgacggagaucccugggcugacagcgaugcgcuggccuucuccggcgugauggucucuaugaaagaaccugggugguacagcuuuggcuucgagaucaaggacaaaaagugcgauguuccguguauuggaaucgaaauggugcacgacggcgggaaagagacauggcauuccgcugccaccgccauuuauugccucaugggaagcggccagcugcuuugggauacagugacgggggucgacauggcucuguga

SEQ ID NO: 213339 - RNA, 1401 nt, Artificial Sequence
  derived and/or modified sequence opt5 from neuraminidase__InfluenzaB__AHZ36778
augcugcccagcaccauccagacacucacgcuguuccuuaccuccggcggggugcugcucucucuguacgucagcgccucccuuucuuaucugcucuacagcgacauucugcugaaguuuccuuccacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaaggaauguaaacauuuugcucucacacacuacgccgcgcagcccgggggauauuacaacggcacccggggcgaccgcaauaagcugagacaucugaucagcgucaagcucgggaaaauuccuacaguggagaacucuaucuuccacauggccgcuugguccggaagcgccugccaugauggcaaggaguggaccuauauugggguugacggacccgauaauaacgcucugcuuaaaaucaaguacggcgaagccuacacggacacauaucacucuuacgcgaauaacauucugcggacccaggaguccgccuguaauugcaucgggggaaacuguuaucucaugauuacagauggcagcgcuuccggcgugucugaaugccgcuuucugaaaaucagagaggggcggaucauuaaggagaucuucccgaccggacgcauucaacacaccgaagaguguacaugcggcuuugccagcaauaagacgaucgaaugugcuugcagagacaacuccuacaccgccaaacggccuuucgucaaacuuaauguggagacagauaccgccgaaauucgccugaugugcacaaagaccuaucucgacacgcccagaccugaggaugggagcaucacaggacccugugagucuaacggcgggaagggauccggcggcaucaaagggggauuuguucaucagcggauggcuagcaagauuggccgcugguacucuagaaccaugagcaaaaccgaacggaaggggaugggacuguaugugaaguacaacggcgaccccugggcggauuccgacgcccuggucuucucuggggugaugaucagcauggaggaaccuggcugguacuccuuuggauucgagauuaaagacaagaaaugcgaugugccguguaucggcauugaaaugguccacgacgggggaaaggagacauggcauagcgcugccaccgccaucuauugccucaugggcucugggcagcugcuuugggauacaguuacgggagugaauaugacccuguga

SEQ ID NO: 213340 - RNA, 1401 nt, Artificial Sequence
  derived and/or modified sequence opt5 from neuraminidase__InfluenzaB__AHZ36789
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcucaaacaaugccgcucgauugcgccaacgcgucuaauguucaggcugugaacagaagcgccaccaaaggagugacacugcuucccccugaacccgaguggaccuauccucggcuguccugucccggcagcacguuccagaaggcccuccugauuucuccucaccgcuuuggggaaaccaaaggaaauuccgcuccgcuuaucauuagagagcccuucaucgccugcggcccuaacgaauguaagcauuuugcucugacacacuacgccgcgcagcccgggggauauuacaauggcacccggggcgaccgcaacaaacucagacaucugaucagcgucaagcuggggaagauuccuacaguggaaaauucuaucuuccacauggccgcuugguccggaagcgccugccaugauggcaaagaguggaccuauauugggguugacggacccgauaacaaugcucuccugaaggugaaauacggcgaggccuacacggacacauaucacucuuacgcgaacaagauccuucggacccaagaguccgccuguaauugcauugggggaaacuguuaucugaugaucacagauggcagcgcuuccggcgucucugaaugccgcuuucucaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacugaauguggagacagauaccgccgaaauuagacuuaugugcacagacaccuaucuggauacgccccggccuaacgacggguccaucacaggacccugugagagcgauggcgacaaggggucuggaggcauuaaaggcggguuuguccaucagcgcaugaaguccaaaaucggaagaugguacagccggaccaugucuaagaccgagagaaugggcauggggcucuaugugaaguacgacggagaucccugggcugacagcgaugcgcuggccuucuccggcgugauggucucuaugaaagaaccugggugguacagcuuuggcuucgagaugaaggacaaaaagugcgauguuccguguaucggaauugaaauggugcacgacggcgggaaagagacauggcauuccgcugccaccgccaucuauugccugaugggaagcggccagcuccugugggauacagugacgggggucgacauggcucuuuga

SEQ ID NO: 213341 - RNA, 1401 nt, Artificial Sequence; identical to SEQ ID NO: 213340
  derived and/or modified sequence opt5 from neuraminidase__InfluenzaB__AHZ36800

SEQ ID NO: 213342 - RNA, 1401 nt, Artificial Sequence
  derived and/or modified sequence opt5 from neuraminidase__InfluenzaB__AHZ36811
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcacaaacgccucuaauguucaggcggugaacagaagcgcugccaaaggagugacccugcuucugcccgaaccugaguggacauauccccggcucuccuguccuggcagcaccuuccagaaggcccugcuuaucucuccccaccgcuuuggggaaauuaaaggaaauuccgcuccucugaucaucagagagccguucauugccugcggccccacggaauguaagcauuuugcucucacccacuacgccgcgcagccugggggauauuacaacggcacacgggaggaccgcaauaaacugagacaucugaucagcgucaagcucggcaagauucccaccguggagaacucuaucuuccacauggccgcuugguccgggagcgccugccaugauggaaaagaauggacauauauuggcguugacgggccugauucuaaugcucugcuuaagaucaaauacggagaggccuacaccgacacguaucacuccuacgcgaagaacauucugcggacacaagaaagcgccuguaauugcaucggcggggauuguuaucucaugaucaccgacggacccgcuuccggcgugucugagugccgcuuucugaaaauuagagagggccggaucauucgcgaaaucuucccgacagggagagucaagcacaccgaggaauguaccugcggauuugccagcaacaagacaauugagugugcuugccgggauaaucgcuacacggccaaaagaccuuucgugaaacuuaacguugaaaccgacacagccgagauccggcugaugugcaccgagacauaucucgauacgccccgcccuaaugacggcuccaucaccgggcccugugaaagcgauggagacaagggcucugggggaauuaagggcggcuuugugcaucagagaauggcuuccaaaaucgggcggugguacagcagaacaaugucuaagaccaaacgcaugggaaugggccuguaugucaaguacgacggggaucccuggaccgacagcgaggcgcuggcccucuccggagugauggugucuauggaggaaccuggcugguacagcuucggguuugaaauuaaggauaaaaagugcgacgucccguguaucggcauugagaugguucacgauggaggcaaaacaaccuggcauuccgcugccacagccaucuauugccugauggggagcggacagcuucugugggacacggugaccggcguggauauggcucucuga

SEQ ID NO: 213343 - RNA, 1404 nt, Artificial Sequence; identical to SEQ ID NO: 213337
  derived and/or modified sequence opt5 from neuraminidase__InfluenzaB__AHZ36822

SEQ ID NO: 213344 - RNA, 1401 nt, Artificial Sequence
  derived and/or modified sequence opt5 from neuraminidase__InfluenzaB__AHZ36833
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaagaccccucgauugcgccaacgcgucuaauguucaagcugugaaccggagcgccaccaaaggagugacacugcuucugccugaacccgaguggaccuauccucgccucuccugucccggcagcacguuccagaaggcccugcuuauuucuccucacagauuuggggaaaccaaaggaaauuccgcuccgcugaucauucgggagcccuucaucgccugcggcccuaacgaauguaagcauuuugcucucacacacuacgccgcgcagcccgggggauauuacaauggcacccgcggcgacagaaacaaacugcggcaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcgcacccaggaguccgccuguaauugcauugggggaaacuguuaucucaugaucacagauggcagcgcuuccggcgucucugaaugcagauuucugaaagugcgggaggggcgcauuaucaaggagaucuucccgaccggaagaguuaagcacaccgaagaguguacaugcggcuuugccagcaauaaaacgauugaaugugcuugccgggacaaccgcuacaccgccaagagaccuuucgugaaacuuaaugucgagacagauaccgccgaaauccggcugaugugcacagacaccuaucucgauacgccccgcccuaacgacggguccauuacaggacccugugagagcgauggcgacaaggggucuggaggcaucaaaggcggguuugugcaucaaagaaugaaguccaaaauuggacggugguacagcagaaccaugucuaagaccgagcgcaugggcauggggcuguaugugaaguacgacggagaucccugggcugacagcgaugcgcuggccuucuccggcgucaugguuucuaugaaagaaccugggugguacagcuuuggcuucgagaucaaggacaaaaagugcgaugugccguguaucggaauugaaauggugcacgacggcgggaaagagacauggcauuccgcugccaccgccaucuauugccucaugggaagcggccagcugcuuugggauacagucacggggguggacauggcucuguga

SEQ ID NO: 213345 - RNA, 1401 nt, Artificial Sequence
  derived and/or modified sequence opt5 from neuraminidase__InfluenzaB__AHZ36844
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaagaccccucgauugcgccaacgcgucuaauguucaagcugugaaccggagcgccaccaaagaagugacacugcuucugccugagcccgaauggaccuauccucgccucuccugucccggaagcacguuccagaaggcccugcuuauuucuccucacagauuuggcgagaccaaaggaaauuccgcuccgcugaucauucgggaacccuucaucgccugcgggccuaacgaguguaagcauuuugcucucacacacuacgccgcgcagcccggcggguauuacaauggaacccgcggcgacagaaacaaacugcggcaucugaucagcgucaagcucggcaagauuccuacaguggaaaauucuaucuuccacauggccgcuugguccgggagcgccugccaugauggaaaagaguggaccuauauuggcguugacgggcccgauaacaaugcucugcuuaaggugaaauacggagaggccuacacggacacauaucacucuuacgcgaacaagauccugcgcacccaggaauccgccuguaauugcauuggcgggaacuguuaucucaugaucacagauggaagcgcuuccggcgucucugagugcagauuucugaaaauucgggagggccgcaucaucaaggaaauuuucccgaccgggagagugaagcacaccgaggaauguacaugcggauuugccagcaauaaaacgaucgagugugcuugccgggacaaccgcuacaccgccaagagaccuuucguuaaacuuaauguggaaacagauaccgccgagauucggcugaugugcacagacaccuaucucgauacgccccgcccuaacgacggcuccaucacagggcccugugagagcgauggagacaagggcucugggggaauuaaaggcggcuuuguccaucaaagaaugaaguccaaaaucgggcggugguacagcagaaccaugucuaagaccgaacgcaugggaaugggccuguaugugaaguacgacggggaucccugggcugacagcgaugcgcuggccuucuccggagugauggucucuaugaaagagccuggcugguacagcuuuggguucgaaaucaaggacaaaaagugcgauguuccguguauuggcaucgagauggugcacgacggaggcaaagaaacauggcauuccgcugccaccgccauuuauugccucauggggagcggacagcugcuuugggauacagugacgggcgucgacauggcucuguga

SEQ ID NO: 213346 - RNA, 1401 nt, Artificial Sequence
  derived and/or modified sequence opt5 from neuraminidase__InfluenzaB__AHZ36855
augcugcccagcaccauccagacacucacgcuguuccuuaccuccggcggggugcugcucucucuguacgucagcgccucccuuucuuaucugcucuacagcgacauucugcugaaguuuuccccuacagagaucaccguucaaacaaugccgcucgauugcgcuaacgccucuaaugugcaggcggugaacagaagcgcuaccaaaggagucacacugcuucccccugaacccgaguggaccuauccucggcuguccugucccggcagcacguuccagaaggcccuccugauuucuccucaccgcuuuggggaaaccaaaggaaauuccgccccgcuuaucauuagagagcccuucaucgcuugcggcccuaacgaauguaagcauuuugcccugacacacuacgcugcccagcccgggggauauuacaauggcacccggggcgaccgcaacaaacucagacaucugaucagcgugaagcuggggaagauuccuacaguugaaaauucuaucuuccacauggcggccugguccggaagcgcuugccaugauggcaaagaguggaccuauauugggguggacggacccgauaacaaugcccuccugaaggucaaauacggcgaggcuuacacggacacauaucacucuuacgccaacaagauccuucggacccaagaguccgcguguaauugcauugggggaaacuguuaucugaugaucacagauggcagcgccuccggcgugucugaaugccgcuuucucaaaauuagagaggggcggaucaucaaggagauuuucccgaccggacgcguuaagcacaccgaagaguguacaugcggcuuugcuagcaauaaaacgaucgaaugugccugcagagacaaccgguacaccgcuaagcgcccuuucgugaaacugaaugucgagacagauaccgccgaaauuagacuuaugugcacagacaccuaucuggauacgccccggccuaacgacggguccaucacaggacccugugagagcgauggcgacaaggggucuggaggcauuaaaggcggguuugugcaucagcgcaugaaguccaaaaucggaagaugguacagccggaccaugucuaagaccgagagaaugggcauggggcucuaugugaaguacgacggagaucccugggccgacagcgaugcucuggcguucuccggcgucaugguuucuaugaaagaaccugggugguacagcuuuggcuucgagaugaaggacaaaaagugcgaugugccguguaucggaauugaaauggugcacgacggcgggaaagagacauggcauuccgccgcuaccgccaucuauugccugaugggaagcggccagcuccugugggauacagucacggggguggacauggcccuuuga

SEQ ID NO: 213347 - RNA, 1404 nt, Artificial Sequence; identical to SEQ ID NO: 213337
  derived and/or modified sequence opt5 from neuraminidase__InfluenzaB__AHZ36866

SEQ ID NO: 213348 - RNA, 1401 nt, Artificial Sequence
  derived and/or modified sequence opt5 from neuraminidase__InfluenzaB__AHZ36877
augcugcccagcaccauccagacacucacgcuguuccuuaccuccggcggggugcugcucucucuguacgucagcgccucccuuucuuaucugcucuacagcgacauucugcugaaguuuuccccuccggagaucacagcucccaccaugccucucgauugcgccaacgcgucuaauguucaagcugugaacagaagcgccacaaaaggagugacccugcuucugcccgaaccugaguggacauauccccggcucuccuguccuggcagcaccuuccagaaggcccugcuuauuucuccgcaccgcuuuggggaaacgaaaggaaauuccgcuccccugaucauuagagagccuuucaucgccugcggccccaacgaauguaagcauuuugcucucacccacuacgccgcgcagccugggggauauuacaauggcacacggggcgaccgcaacaaacugagacaucugaucagcgucaagcucgggaagauucccaccguggaaaauucuaucuuccacauggccgcuugguccggaagcgccugccaugauggcaaagaguggacauauauugggguugacggaccggauaacaaugcucugcuuaaggugaaauacggcgaggccuacaccgacacguaucacucuuacgcgaacaagauccugcggacacaggaguccgccuguaauugcauugggggaaacuguuaucucaugaucaccgauggcagcgcuuccggcgucucugaaugccgcuuucugaaaauuagagaggggcggaucaucaaggagauuuucccuacaggacgcgugaagcacaccgaagaguguaccugcggcuuugccagcaauaaaacaaucgaaugugcuugcagagacaaccgguacacggccaagcgccccuucguuaaacuuaauguggagaccgauacagccgaaauuagacugaugugcaccgacacauaucucgauaccccucggcccaacgacggguccaucacgggacccugugagagcgauggcgacaaggggucuggaggcauuaaaggcggguuuguccaucaacgcaugaaguccaaaaucggaagaugguacagccggacaaugucuaagaccgagagaaugggcauggggcuguaugugaaguacgacggagauccuugggcugacagcgaugcgcuggccuucuccggcgugauggucucuaugaaagaaccggggugguacagcuuuggcuucgagaucaaggacaaaaagugcgauguucccuguauuggaaucgaaauggugcacgacggcgggaaagagaccuggcauuccgcugccacagccauuuauugccucaugggaagcggccagcugcuuugggauaccgugacaggggucgacauggcucuguga

SEQ ID NO: 213349 - RNA, 1404 nt, Artificial Sequence; identical to SEQ ID NO: 213337
  derived and/or modified sequence opt5 from neuraminidase__InfluenzaB__AHZ36888

SEQ ID NO: 213350 - RNA, 1404 nt, Artificial Sequence; identical to SEQ ID NO: 213337
  derived and/or modified sequence opt5 from neuraminidase__InfluenzaB__AHZ36899

SEQ ID NO: 213351 - RNA, 1404 nt, Artificial Sequence; identical to SEQ ID NO: 213337
  derived and/or modified sequence opt5 from neuraminidase__InfluenzaB__AHZ36910

SEQ ID NO: 213352 - RNA, 1401 nt, Artificial Sequence; identical to SEQ ID NO: 213339
  derived and/or modified sequence opt5 from neuraminidase__InfluenzaB__AHZ36921

SEQ ID NO: 213353 - RNA, 1401 nt, Artificial Sequence
  derived and/or modified sequence opt5 from neuraminidase__InfluenzaB__AHZ36932
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcucaaacaaugccgcucgauugcgccaacgcgucuaauguucaggcugugaacagaagcgccaccaaaggagugacacugcuucccccugaacccgaguggaccuauccucggcuguccugucccggcagcacguuccagaaggcccuccugauuucuccucaccgcuuuggggaaaccaaaggaaauuccgcuccgcuuaucauuagagagcccuucaucgccugcggcccuaacgaauguaagcauuuugcucugacacacuacgccgcgcagcccgggggauauuacaauggcacccggggcgaccgcaacaaacucagacaucugaucagcgucaagcuggggaagauuccuacaguggaaaauucuaucuuccacauggccgcuugguccggaagcgccugccaugauggcaaagaguggaccuauauugggguugacggacccgauaacaaugcucuccugaaggugaaauacggcgaggccuacacggacacauaucacucuuacgcgaacaagauccuucggacccaagaguccgccuguaauugcauugggggaaacuguuaucugaugaucacagauggcagcgcuuccggcgucucugaaugccgcuuucucaaaauuagagaggggcggaucaucaaggagauuuucccgaccggacgcgugaagcacaccgaagaguguacaugcggcuuugccagcaauaaaacgauggaaugugcuugcagagacaaccgguacaccgccaagcgcccuuucguuaaacugaauguggagacagauaccgccgaaaucagacuuaugugcacagacaccuaucuggauacgccccggccuaacgacggguccauuacaggacccugugagagcgauggcgacaaggggucuggaggcaucaaaggcggguuuguccaucagcgcaugaaguccaaaauuggaagaugguacagccggaccaugucuaagaccgagagaaugggcauggggcucuaugugaaguacgacggagaucccugggcugacagcgaugcgcuggccuucuccggcgugauggucucuaugaaagaaccugggugguacagcuuuggcuucgagaugaaggacaaaaagugcgauguuccguguaucggaaucgaaauggugcacgacggcgggaaagagacauggcauuccgcugccaccgccauuuauugccugaugggaagcggccagcuccugugggauacagugacgggggucgacauggcucuuuga

SEQ ID NO: 213354 - RNA, 1401 nt, Artificial Sequence
  derived and/or modified sequence opt5 from neuraminidase__InfluenzaB__AHZ36943
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuuccucccgaaccugaguggaccuauccccggcuguccuguccuggcagcacguuccagaaggcccuccugauuucuccgcaccgcuuuggggaaaccaaaggaaauuccgcuccccuuaucauuagagagccuuucaucgccugcggccccaacgaauguaagcauuuugcucugacacacuacgccgcgcagccugggggauauuacaauggcacccggggcgaccgcaacaaacucagacaucugaucagcgucaagcuggggaagauucccacaguggaaaauucuaucuuccacauggccgcuugguccggaagcgccugccaugauggcaaagaguggaccuauauugggguugacggaccggauaacaaugcucuccugaaggugaaauacggcgaggccuacacggacacauaucacucuuacgcgaacaagauccuucggacccaggaguccgccuguaauugcauugggggaaacuguuaucugaugaucacagauggcagcgcuuccggcgucucugaaugccgcuuucucaaaauuagagaggggcggaucaucaaggagauuuucccuaccggacgcgugaagcacaccgaagaguguacaugcggcuuugccagcaauaaaacgaucgaaugugcuugcagagacaaccgguacaccgccaagcgccccuucguuaaacugaauguggagacagauaccgccgaaauuagacuuaugugcacagacaccuaucuggauacgccucggcccaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcucuaugugaaguacgacggagauccuugggcugacagcgaugcgcuggccuucuccggcgugauggucucuaugaaagaaccggggugguacagcuuuggcuucgagaugaaggaccgcaaaugcgauguucccuguaucggaauugaaauggugcacgacggcgggaaggagacauggcauuccgcugccaccgccaucuauugccugaugggaagcggccagcuccugugggauacagugacgggggucgacauggcucuuuga

SEQ ID NO: 213355 - RNA, 1404 nt, Artificial Sequence; identical to SEQ ID NO: 213337
  derived and/or modified sequence opt5 from neuraminidase__InfluenzaB__AHZ36954

SEQ ID NO: 213356 - RNA, 1401 nt, Artificial Sequence
  derived and/or modified sequence opt5 from neuraminidase__InfluenzaB__AHZ36965
augcugcccagcaccauccagacacucacgcuguuccuuaccuccggcggggugcugcucucucuguacgucagcgccucccuuucuuaucugcucuacagcgacauucugcugaaguuuuccccuccggagaucaacgcucccacaaugccucucgauugcgccaaugcgucuaacguucaagcugugaauagaagcgccaccaaaggagugacacugcuucugcccgaaccugaguggaccuauccccggcucuccuguccuggcagcacauuccagaaggcccugcuuauuucuccgcaccgcuuuggggaaaccaaaggaaacuccgcuccccugaucauuagagagccuuucaucgccugcggccccaaugaauguaagcauuuugcucucacgcacuacgccgcgcagccugggggauauuacaacggcacccggggcgaccgcaauaaacugagacaucugaucagcgucaagcucgggaagauucccacaguggagaacucuaucuuccacauggccgcuugguccggaagcgccugccaugauggcaaagaguggaccuauauugggguugacggaccggauaauaacgcucugcuuaaggugaaauacggcgaagccuacacagacaccuaucacucuuacgcgaauaagauccugcggacgcaggaguccgccuguaacugcauugggggaaauuguuaucucaugaucacagauggcagcgcuuccggcgucucugaaugccgcuuucugaaaauuagagaggggcggaucaucaaggagauuuucccuaccggacgcgugaagcacacagaagaguguaccugcggcuuugccagcaacaaaaccaucgaaugugcuugcagagacaaucgguacacagccaagcgccccuucguuaaacuuaacguggagacggauaccgccgaaauuagacugaugugcacagacaccuaucucgauacaccucggcccaacgacggguccaucaccggacccugugagagcgauggcgacaaggggucuggaggcauuaaaggcggguuuguccaucaacgcaugaaguccaaaaucggaagaugguacagccggacgaugucuaagacagagagaaugggcauggggcuguaugugaaguacgacggagauccuugggcugacagcgaugcgcuggccuucuccggcgugauggucucuaugaaagaaccggggugguacagcuuuggcuucgagaucaaggacaaaaagugcgauguucccuguauuggaaucgaaauggugcacgacggcgggaaagagaccuggcauuccgcugccaccgccauuuauugccucaugggaagcggccagcugcuuugggauacagugaccggggucgacauggcucuguga

SEQ ID NO: 213357 - RNA, 1404 nt, Artificial Sequence; identical to SEQ ID NO: 213337
  derived and/or modified sequence opt5 from neuraminidase__InfluenzaB__AHZ36976

SEQ ID NO: 213358 - RNA, 1404 nt, Artificial Sequence; identical to SEQ ID NO: 213337
  derived and/or modified sequence opt5 from neuraminidase__InfluenzaB__AHZ36987

SEQ ID NO: 213359 - RNA, 1401 nt, Artificial Sequence; identical to SEQ ID NO: 213340
  derived and/or modified sequence opt5 from neuraminidase__InfluenzaB__AHZ36998

SEQ ID NO: 213360 - RNA, 1401 nt, Artificial Sequence
  derived and/or modified sequence opt5 from neuraminidase__InfluenzaB__AHZ37009
augcugcccagcaccauccagacacucacgcuguuccuuacccugggcggggugcuccugucccuuuacgucucugccagccuguccuaucuccuguacucugacauucugcucaaguuuagcccuacagagaucaccgcuccgacaaugccccugggaugcgccaacgcguccaauguucaagcugugaacagaucugccaccaaaggcgugacacuucugcucccugaacccgaguggaccuauccucggcugagcugucccggguccacguuccagaaggcccuucugauuagcccucaccgcuuuggagaaaccaaaggcaauucugcuccgcucaucauuagagagcccuucaucgccugcgggccuaacgaauguaagcauuuugcucugacacacuacgccgcgcagcccggaggcuauuacaauggcacccgcggggaucggaacaaacugagacaucucaucuccgucaagcugggaaagauuccuacaguggagaauagcaucuuccacauggccgcuuggucuggcuccgccugccaugacgggaaagaguggaccuauauuggaguugauggccccgacaacaaugcucugcuuaaggugaaauacggggaagccuacacggauacauaucacagcuacgcgaacaagauccuccggacccaggagucugccuguaauugcauuggaggcaacuguuaucugaugaucacagacggcuccgcuagcggggucuccgaaugccgcuuucuuaaaauuagagagggacggaucaucaaggagauuuucccgaccggccgcgugaagcacaccgaagaguguacaugcggguuugccucuaauaaaacgaucgaaugugcuugcagagauaaccgguacaccgccaagcgcccuuucguuaaacugaauguggaggccgacacagcugaaauuagacucaugugcaccgauacauaucuggacacgccccggccuaacgauggaagcaucaccggccccugugaguccgacggggauaagggaagcggcggcauuaaagggggauuuguccaucaacgcaugaagucuaaaaucggcagaugguacucccggacaaugagcaagaccgagagaauggggaugggacuguaugugaaguacgacggcgaccccugggcggauucugacgcccucgcuuucagcggggugauggucuccaugaaagaaccuggcugguacucuuuuggauucgagaucaaggauaaaaagugcgacguuccguguauuggcaucgaaauggugcacgaugggggaaaagagaccuggcauagcgccgccacagcuauuuauugccugaugggcuccgggcagcuucugugggacaccgugacaggagucgauauggcccucuga

SEQ ID NO: 213361 - RNA, 1401 nt, Artificial Sequence; identical to SEQ ID NO: 213338
  derived and/or modified sequence opt5 from neuraminidase__InfluenzaB__AHZ37020

SEQ ID NO: 213362 - RNA, 1401 nt, Artificial Sequence; identical to SEQ ID NO: 213340
  derived and/or modified sequence opt5 from neuraminidase__InfluenzaB__AHZ37031

SEQ ID NO: 213363 - RNA, 1401 nt, Artificial Sequence; identical to SEQ ID NO: 213338
  derived and/or modified sequence opt5 from neuraminidase__InfluenzaB__AHZ37042

SEQ ID NO: 213364 - RNA, 1401 nt, Artificial Sequence; identical to SEQ ID NO: 213340
  derived and/or modified sequence opt5 from neuraminidase__InfluenzaB__AHZ37064

SEQ ID NO: 213365 - RNA, 1401 nt, Artificial Sequence; identical to SEQ ID NO: 213338
  derived and/or modified sequence opt5 from neuraminidase__InfluenzaB__AHZ37075

SEQ ID NO: 213366 - RNA, 1401 nt, Artificial Sequence; identical to SEQ ID NO: 213338
  derived and/or modified sequence opt5 from neuraminidase__InfluenzaB__AHZ37086

SEQ ID NO: 213367 - RNA, 1401 nt, Artificial Sequence
  derived and/or modified sequence opt5 from neuraminidase__InfluenzaB__AHZ37097
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuuccucccgaaccugaguggaccuauccccggcuguccuguccuggcagcacguuccagaaggcccuccugauuucuccgcaccgcuuuggggaaaccaaaggaaauuccgcuccccuuaucauuagagagccuuucaucgccugcggccccaacgaauguaagcauuuugcucugacacacuacgccgcgcagccugggggauauuacaauggcacccggggcgaccgcaacaaacucagacaucugaucagcgucaagcuggggaagauucccacaguggaaaauucuaucuuccacauggccgcuugguccggaagcgccugccaugauggcaaagaguggaccuauauugggguugacggaccggauaacaaugcucuccugaaggugaaauacggcgaggccuacacggacacauaucacucuuacgcgaacaagauccuucggacccaggaguccgccuguaauugcauugggggaaacuguuaucugaugaucacagauggcagcgcuuccggcgucucugaaugccgcuuucucaaaauuagagaggggcggaucaucaaggagauuuucccuaccggacgcgugaagcacaccgaagaguguacaugcggcuuugccagcaauaaaacgaucgaaugugcuugcagagacaaccgguacaccgccaagcgccccuucguuaaacugaauguggagacagauaccgccgaaauuagacuuaugugcacagacaccuaucuggauacgccucggcccaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcucuaugugaaguacgacggagauccuugggcugacagcgaugcgcuggccuucuccggcgugauggucucuaugaaagaaccggggugguacagcuuuggcuucgagaugaaggacaaaaagugcgauguucccuguaucggaauugaaauggugcacgacggcgggaaagagacauggcauuccgcugccaccgccaucuauugccugaugggaagcggccagcuccugugggauacagugacgggggucgacauggcucuuuga

SEQ ID NO: 213368 - RNA, 1401 nt, Artificial Sequence; identical to SEQ ID NO: 213338
  derived and/or modified sequence opt5 from neuraminidase__InfluenzaB__AHZ37108

SEQ ID NO: 213369 - RNA, 1401 nt, Artificial Sequence
  derived and/or modified sequence opt5 from neuraminidase__InfluenzaB__AHZ41774
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcagcaacgaaugucggcacuucgcucugacccauuacgccgcgcagccugggggauauuacaauggcacacgcggcgacagaaacaagcuccggcaccugaucucugucaaacuggggaagauucccaccguggaaaauuccaucuuucauauggccgcuuggagcggaucugccugccacgauggcaaggaguggacauauauugggguugacggaccugauaacaaugcucuccugaaaaucaaguacggcgaggccuacaccgacacguaucacuccuacgcgaacaauauucuucgcacacaggagagcgccuguaacugcaucgggggaaauuguuaucugaugauuaccgauggcuccgcuucuggcgugagcgaaugcagauuccucaaaauccgggaggggcgcaucauuaaggagaucuuucccacaggaagagucaaacauaccgaagaguguaccugcggcuucgccuccaacaagacaauugaaugugcuugccgggacaauagcuacacggccaagcgcccguuugugaaacugaacguugagaccgauacagccgaaaucagacuuaugugcaccgacacauaucuggauaccccucggcccgacgaugggucuauuacgggaccuugugaguccaacggcgacaaggggagcggaggcaucaaaggcggguucgugcaccagcgcauggcuucuaagaucggaagaugguacagccggacaauguccaaaaccgagagaaagggcauggggcucuaugucaaauacgacggagaucccuggaccgacaaugaugcgcuggccuuucgcggcgugauggugucuaugaaggaacccgggugguacagcuucggcuucgagauuaaggacaaaaagugcgaugucccuuguaucggaauugaaaugguucaugacggcgggaaagagacauggcacuccgcugccaccgccaucuauugccugaugggaagcggccaacuccugugggauacagugacggggguggacauggcucuuuga

SEQ ID NO: 213370 - RNA, 1401 nt, Artificial Sequence; identical to SEQ ID NO: 211980
  derived and/or modified sequence opt5 from neuraminidase__InfluenzaB__AHZ41785

SEQ ID NO: 213371 - RNA, 1401 nt, Artificial Sequence; identical to SEQ ID NO: 211980
  derived and/or modified sequence opt5 from neuraminidase__InfluenzaB__AHZ41796

SEQ ID NO: 213372 - RNA, 1401 nt, Artificial Sequence
  derived and/or modified sequence opt5 from neuraminidase__InfluenzaB__AHZ41807
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaauguaagcacuucgcucugacccauuacgccgcgcagcccgggggauauuacaauggcacacggggcgaccgcaacaaacucagacaccugaucagcgucaagcuggggaagauuccuaccguggaaaauucuaucuuucauauggccgcuugguccggaagcgccugccacgauggcaaagaguggacauauauugggguugacggacccgauaacaaugcucuccugaagaucaaauacggcgaggccuacaccgacacguaucacucuuacgcgaacaauauucuucggacacaggaguccgccuguaacugcaucgaagggaauuguuaucugaugauuaccgauggaagcgcuuccggcgugucugagugccgcuuccucaagaucagagagggccggaucauuaaagaaaucuuuccgacagggcgcgucaagcauaccgaggaauguaccugcggauucgccagcaacaagacaauugagugugcuugcagagacaauuccuacacggccaaacggccuuuugugaagcugaacguugaaaccgauacagccgagauccgccuuaugugcaccgacacauaucuggauacccccagaccugacgauggcagcauuacggggcccugugagucuaacggagacaaaggcuccgggggaaucaagggcggcuucgugcaccagcggauggcuagcaaaaucgggcgcugguacucuagaacaaugagcaagaccgaacggaaaggaaugggccucuaugucaaguacgacggggaucccuggaccgacuccgaugcgcuggccuuuagaggagugauggugucuaugaaggagccuggcugguacagcuucggguucgaaauuaaagacaagaaaugcgaugucccguguaucggcauugagaugguucaugacggaggcaaggaaacauggcacuccgcugccaccgccaucuauugccugauggggagcggacaacuccugugggauacagugacgggcguggacauggcucuuuga

SEQ ID NO: 213373 - RNA, 1401 nt, Artificial Sequence
  derived and/or modified sequence opt5 from neuraminidase__InfluenzaB__AHZ41818
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucauggucacagauggcagcgcuuccggcgugucugaaugccgcuuucugaaaaucagagaggggcggauuaucaaggagaucuucccgaccggacgcguuaagcacaccgaagaguguacaugcggcuuugccagcaauaaaacgauugaaugugcuugcagagacaacuccuacaccgccaagcggccuuucgugaaacuuaaugucgagacagauaccgccgaaauccgccugaugugcacagacaccuaucucgauacgcccagaccugacgaugggagcauuacaggacccugugagucuaacggcgacaagggguccggaggcaucaaaggcggguuugugcaucaacggauggagagcaagauuggacgcugguacucuagaaccaugagcaaaaccgaacggaugggcauggggcuguaugugaaguacgacggagaucccugggcugacuccgaugcgcuggucuucucuggcguuauggugagcaugaaggagccugggugguacuccuuuggcuucgaaaucaaagacaagaaaugcgaugugccguguaucggaauugagaugguccacgacggcgggaaggaaacauggcauagcgccgcuaccgccaucuauugccucaugggaucuggccagcugcuuugggauacagugacggggguuaacauggcccuguga

SEQ ID NO: 213374 - RNA, 1401 nt, Artificial Sequence; identical to SEQ ID NO: 211980
  derived and/or modified sequence opt5 from neuraminidase__InfluenzaB__AHZ41829

SEQ ID NO: 213375 - RNA, 1401 nt, Artificial Sequence
  derived and/or modified sequence opt5 from neuraminidase__InfluenzaB__AHZ41840
augcugcccagcaccauccagaugcucacacuguuccuuacguccggcggggugcugcucucucuguacgucagcgccucccuuucuuaucugcucuacagcgacauucugcugaaguuuuccccuaccgagaucacagcuccgaccaugccccucgauugcgccaacgcgucuaauguucacgcugugaacagaagcgccacaaaaggagugaccuuccugcuuccugaacccgaguggacauauccucggcuguccugucccggcagcaccuuucaaaaggcccuccugauuucuccucaucgcuucggggaaacgaaaggaaauuccgcuccgcuuaucauuagagagcccuuuaucgccugcggcccuaacgaaugucggcacuucgcucugacccauuacgccgcgcagcccgggggauauuacaauggcacacgcggcgacagaaacaagcuccggcaccugaucagcgucaaacuggggaagauuccuaccguggaaaauucuaucuuucauauggccgcuugguccggaagcgccugccacgauggcaaggaguggacauauauugggguugacggacccgauaacaaugcucuccugaaaaucaaguacggcgaggccuacaccgacacguaucacucuuacgcgaacaauauucuucgcacacaggaguccgccuguaacugcaucgggggaaauuguuaucugaugauuaccgauggcagcgcuuccggcgugucugaaugcagauuccucaaaauccgggaggggcgcaucauuaaggagaucuuuccgacaggaagagucaaacauaccgaagaguguaccugcggcuucgccagcaacaagacaauugaaugugcuugccgggacaauuccuacacggccaagcgcccuuuugugaaacugaacguugagaccgauacagccgaaaucagacuuaugugcaccgacacauaucuggauacgccccggccugacgaugggagcauuaccggacccugugagucuaacggcgacaagggguccggaggcaucaaaggcggguucgugcaccagcgcauggcuagcaagaucggaagaugguacucucggacaaugagcaaaaccgagagaaagggcauggggcucuaugucaaauacgacggagaucccuggaccgacuccgaugcgcuggccuuucgcggcgugauggugucuaugaaggaaccugggugguacagcuucggcuucgagauuaaggacaaaaagugcgaugucccguguaucggaauugaaaugguucaugacggcgggaaagagacauggcacuccgcugccaccgccaucuauugccugaugggaagcggccaacuccugugggauacagugacggggguggacauggcucuuuga

SEQ ID NO: 213376 - RNA, 1401 nt, Artificial Sequence; identical to SEQ ID NO: 211980
  derived and/or modified sequence opt5 from neuraminidase__InfluenzaB__AHZ41851

SEQ ID NO: 213377 - RNA, 1401 nt, Artificial Sequence; identical to SEQ ID NO: 213226
  derived and/or modified sequence opt5 from neuraminidase__InfluenzaB__AHZ41862

SEQ ID NO: 213378 - RNA, 1401 nt, Artificial Sequence
  derived and/or modified sequence opt5 from neuraminidase__InfluenzaB__AHZ41873
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaaugcucaagccguuaacagaagcgccaccaaaggagugacacugcuucugccugaacccgaguggaccuauccucggcucuccugucccggcagcacguuccagaaggcucugcuuauuucuccucaccgcuuuggggaaaccaaaggaaauuccgccccgcugaucauuagagagcccuucaucgcuugcggcccuaacgaauguaagcauuuugcccucacacacuacgcggcccagcccgggggauauuacaauggcacccggggcgaccgcaacaaacugagacaucugaucagcgugaagcucgggaagauuccuacagucgaaaauucuaucuuccacauggcugccugguccggaagcgcuugccaugauggcaaagaguggaccuauauugggguggacggacccgauaacaaugcccugcuuaagguuaaauacggcgaggcguacacggacacauaucacucuuacgccaacaagauccugcggacccaggaguccgcuuguaauugcauugggggaaacuguuaucucaugaucacagauggcagcgccuccggcgugucugaaugccgcuuucugaaaauuagagaggggcggaucaucaaggagauuuucccgaccggacgcgucaagcacaccgaagaguguacaugcggcuuugcuagcaauaaaacgaucgaaugugccugcagagacaaccgguacaccgccaagcgcccuuucgugaaacuuaauguugagacagauaccgcugaaauuagacugaugugcacagacaccuaucucgauacgccccggccuaacgacggguccaucacaggacccugugagagcgauggcgacaaggggucuggaggcauuaaaggcggguuugugcaucaacgcaugaaguccaaaaucggaagaugguacagccggaccaugucuaagaccgagagaaugggcauggggcuguaugucaaguacgacggagaucccugggcggacagcgaugcccugacauucuccggcgugauggugucuaugaaagaaccugggugguacagcuuuggcuucgagaucaaggacaaaaagugcgaugucccguguauuggaaucgaaaugguucacgacggcgggaaagagaccuggcauuccgcugccacagccauuuauugccucaugggaagcggccagcugcuuugggauacggugaccgggguggacauggcucuguga

SEQ ID NO: 213379 - RNA, 1401 nt, Artificial Sequence; identical to SEQ ID NO: 211816
  derived and/or modified sequence opt5 from neuraminidase__InfluenzaB__AIL94981

SEQ ID NO: 213380 - RNA, 1401 nt, Artificial Sequence; identical to SEQ ID NO: 211816
  derived and/or modified sequence opt5 from neuraminidase__InfluenzaB__AIL94992

SEQ ID NO: 213381 - RNA, 1401 nt, Artificial Sequence; identical to SEQ ID NO: 211841
  derived and/or modified sequence opt5 from neuraminidase__InfluenzaB__AIL95003

SEQ ID NO: 213382 - RNA, 1401 nt, Artificial Sequence
  derived and/or modified sequence opt5 from neuraminidase__InfluenzaB__AIL95014
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaacagaagcgccgccaaaggagugacacugcuucugcccgaaccugaguggaccuauccccggcucuccuguccuggcagcacauuccagaaggcucugcuuaucucuccccaccgcuuuggggaaaccaaaggaaauuccgccccucugauuaucagagagccguucaucgcuugcggccccacggaauguaagcauuuugcccucacccacuacgcggcccagccugggggauauuacaacggcacacgggaggaccgcaauaaacugagacaucugauuagcgucaagcucggcaagauccccaccguggagaacucuauuuuccacauggcugccugguccgggagcgcuugccaugauggaaaagaauggacauauaucggcguugacgggccugauucuaaugcccugcuuaagauuaaauacggagaggcguacaccgacacguaucacuccuacgccaagaacauccugcggacacaagaaagcgcuuguaauugcauuggcggggauuguuaucucaugaucaccgacggacccgccuccggcgugucugagugccgcuuucugaaaaucagagagggccggauuaucaaggaaauuuucccgacagggcgcgucaagcacaccgaggaauguaccugcggauuugcuagcaacaaaacaaucgagugugccugcagagauaauuccuacacggccaagcggccuuucgugaaacuuaacguugaaaccgacacagcugagauucgccugaugugcaccgagacauaucucgauacccccagaccuaaugacggcagcaucacggggcccugugaaucugauggagacaagggcuccgggggaaucaaaggcggcuuugugcaucagcggauggcgagcaagauugggcgcugguacucuagaacaaugagcaaaaccaagcggaugggaaugggccuguaugucaaguacgacggggaucccuggaccgacuccgaggcccuggcucucucuggagugauggugagcauggaggaaccuggcugguacuccuucggguuugaaaucaaagauaagaaaugcgacgucccguguauuggcaucgagaugguucacgauggaggcaagacaaccuggcauagcgccgccacagcuauuuauugccugauggggucuggacagcuucugugggacacggugaccggcguggauaugacacucuga

SEQ ID NO: 213383 - RNA, 1401 nt, Artificial Sequence; identical to SEQ ID NO: 211841
  derived and/or modified sequence opt5 from neuraminidase__InfluenzaB__AIL95025

SEQ ID NO: 213384 - RNA, 1401 nt, Artificial Sequence
  derived and/or modified sequence opt5 from neuraminidase__InfluenzaB__AIL95036
augcugagcuccaccauccagacacucacgcuguuccuuaccucuggcggggugcugcucagccuguacgucuccgccucucuuagcuaucugcucuacuccgacauucugcugaaguuuucucccaaagagaucacagcuccuaccaugccgcucgauugcgccaacgcgagcaauguucaagcugugaaccacuccgccacaaagggagugacccugcuucugcccgaaccugaguggacauaucccagacucagcuguccuggcucuaccuuccagaaagcccugcuuauuagcccccaucgguuuggggaaacgaagggaaauuccgcuccucugaucauucgcgagccguucaucgccugcggccccaacgaauguaaacacuuugcucucacccauuacgccgcgcagccugggggauauuacaauggcacaagaggcgaccggaacaagcugcgccaccugaucucugucaagcucgggaaaauucccaccguggaaaauuccaucuuccauauggccgcuuggagcggaucugccugccacgauggcaaggaguggacauauauugggguugacggaccugauaacaaugcucugcuuaaagugaaguacggcgaggccuacaccgacacguaucacuccuacgcgaacaaaauccugagaacacaggagagcgccuguaauugcauugggggaaacuguuaucucaugaucaccgauggcuccgcuucuggcgucagcgaaugccgguuucugaagauucgcgaggggagaaucaucaaggagauuuuccccacaggacgggugaaacauaccgaagaguguaccugcggcuuugccuccaauaagacaaucgaaugugcuugccgcgacaacagcuacacggccaaaagaccguucguuaaacuuaauguggagaccgauacagccgaaauucggcugaugugcaccgacacauaucucgauaccccucgccccgacgaugggucuaucacgggaccuugugaguccaacggcgacaaggggagcggaggcauuaagggcggguuuguccaccaaagaauggagucuaaaaucggacggugguacagccgcacaauguccaagaccgaaagaaugggcauggggcuguaugugaaguacgacggagaucccugggcugacucugaugcgcuggccuucagcggcgugauggucuccaugaaagagcccgggugguacagcuuuggcuucgaaaucaaggacaaaaagugcgauguuccuuguauuggaaucgagauggugcaugacggcgggaaagaaaccuggcacucugcugccacagccauuuauugccucaugggauccggccagcugcuuugggauaccgugacaggggucgacauggcucuguga

SEQ ID NO: 213385 - RNA, 1401 nt, Artificial Sequence; identical to SEQ ID NO: 211841
  derived and/or modified sequence opt5 from neuraminidase__InfluenzaB__AIL95047

SEQ ID NO: 213386 - RNA, 1401 nt, Artificial Sequence; identical to SEQ ID NO: 211950
  derived and/or modified sequence opt5 from neuraminidase__InfluenzaB__AIL95058

SEQ ID NO: 213387 - RNA, 1401 nt, Artificial Sequence; identical to SEQ ID NO: 211899
  derived and/or modified sequence opt5 from neuraminidase__InfluenzaB__AIL95069

SEQ ID NO: 213388 - RNA, 1401 nt, Artificial Sequence
  derived and/or modified sequence opt5 from neuraminidase__InfluenzaB__AIL95080
augcugcccagcaccauccagacacucacgcuguuccuuaccuccggcggggugcugcucucucuguacgucagcgccucccuuucuuaucugcucuacagcgacauucugcugaaguuuuccccuaaagagaucacagcuccgaccaugccccucgauugcgccaacgcgucuaauguucaagcugugaaccacagcgccacaaagggagugacccugcuucugccugaacccgaguggacauauccuagacucuccugucccggcagcaccuuccagaaagcccugcuuauuucuccucaucgguuuggggaaacgaagggaaauuccgcuccgcugaucauucgcgagcccuucaucgccugcggcccuaacgaauguaaacacuuugcucucacccauuacgccgcgcagcccgggggauauuacaauggcacaagaggcgaccggaacaagcugcgccaccugaucagcgucaagcucgggaaaauuccuaccguggaaaauucuaucuuccauauggccgcuugguccggaagcgccugcaacgauggcaaggaguggacauauauugggguugacggacccgauaauaacgcucugcuuaaagugaaguacggcgaggccuacaccgacacguaucacucuuacgcgaauaaaauccugagaacacaggaguccgccuguaacugcauugggggaaauuguuaucucaugaucaccgauggcagcgcuuccggcgucucugaaugccgguuucugaagauucgcgaggggagaaucaucaaggagauuuucccgacaggacgggugaaacacaccgaagaguguaccugcggcuuugccagcaacaagacaaucgaaugugcuugccgcgacaauuccuacacggccaaaagaccuuucguuaaacuuaacguggagaccgauacagccgaaauucggcugaugugcaccgacacauaucucgauacgccccgcccugacgaugggagcaucaccggacccugugagucuaacggcgacaagggguccggaggcauuaagggcggguuuguccaucaaagaauggagagcaaaaucggacggugguacucucgcacaaugagcaagaccgaaagaaugggcauggggcuguaugugaaguacgacggagaucccugggcugacuccgaugcgcuggccuucucuggcgugauggucagcaugaaagagccugggugguacuccuuuggcuucgaaaucaaggacaaaaagugcgauguuccguguauuggaaucgagauggugcacgacggcgggaaagaaaccuggcauagcgcugccacagccauuuauugccucaugggaucuggccagcugcuuugggauaccgugacaggggucgacauggcucuguga

SEQ ID NO: 213389 - RNA, 1401 nt, Artificial Sequence; identical to SEQ ID NO: 211899
  derived and/or modified sequence opt5 from neuraminidase__InfluenzaB__AIL95091

SEQ ID NO: 213390 - RNA, 1401 nt, Artificial Sequence; identical to SEQ ID NO: 211841
  derived and/or modified sequence opt5 from neuraminidase__InfluenzaB__AIL95102

SEQ ID NO: 213391 - RNA, 1401 nt, Artificial Sequence
  derived and/or modified sequence opt5 from neuraminidase__InfluenzaB__AIL95113
augcugcccagcaccauccagacacucacgcuguuccuuaccuccggcggggugcugcucucucuguacgucagcgccucccuuucuuaucugcucuacagcgacauucugcugaaguuuuccccuacaggaaucaccgcuccgacaaugccccucgauugcgccaacgcgucuaauguucaagcugugaacagaagcgccaccaaaggcgugacacugcuuccucccgagccugaauggaccuauccccggcuguccuguccugggagcacguuccagaaggcccuccugauuucuccgcaccgcuuuggagagaccaaaggcaauuccgcuccccuuaucauuagagaaccuuucaucgccugcgggcccaacgaguguaagcauuuugcucugacacacuacgccgcgcagccuggaggcuauuacaauggcacccgcggggaccggaacaaacucagacaucugaucagcgucaagcugggaaagauucccacaguggaaaauucuaucuuccacauggccgcuugguccggcagcgccugccaugaugggaaagaguggaccuauauuggaguugacggcccggauaacaaugcucuccugaaggugaaauacggggaggccuacacggacacauaucacucuuacgcgaacaagauccuucggacccaggaauccgccuguaauugcauuggaggcaacuguuaucugaugaucacagauggcagcgcuuccggggucucugagugccgcuuucucaaaauuagagaaggacggaucaucaaggagauuuucccuaccggccgcgugaagcacaccgaggaauguacaugcggguuugccagcaauaaaacgaucgagugugcuugcagagacaaccgguacaccgccaagcgccccuucguuaaacugaauguggaaacagauaccgccgagauuagacuuaugugcacagacaccuaucuggauacgccucggcccaacgacggauccaucacaggccccugugaaagcgauggggacaagggaucuggcggcauuaaagggggauuuguccaucaacgcaugaaguccaaaaucggcagaugguacagccggaccaugucuaagaccgagagaauggggaugggacucuaugugaaguacgacggcgauccuugggcugacagcgaugcgcuggccuucuccggggugauggucucuaugaaagagccgggcugguacagcuuuggauucgaaaugaaggacaaaaagugcgauguucccuguaucggcauugagauggugcacgacgggggaaaagaaacauggcauuccgcugccaccgccaucuauugccugaugggcagcgggcagcuccugugggauacagugacgggagucgacauggcucuuuga

SEQ ID NO: 213392 - RNA, 1401 nt, Artificial Sequence; identical to SEQ ID NO: 213338
  derived and/or modified sequence opt5 from neuraminidase__InfluenzaB__AIL95124

SEQ ID NO: 213393 - RNA, 1401 nt, Artificial Sequence
  derived and/or modified sequence opt5 from neuraminidase__InfluenzaB__AKA54777
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagacagggcggugguacucuagaaccaugagcaaaaccaagcgcaugggaaugggccucuaugucaaguacgacggggauccuuggacagacuccgaggcgcuggcccugucuggagugauggugagcauggaggaaccgggcugguacuccuucggguuugaaauuaaagauaagaaaugcgacguccccuguaucggcauugagaugguucacgauggaggcaagaccacauggcauagcgcugccacggccaucuauugccucauggggucuggacagcugcuuugggacaccgugacaggcgugaacaugacccuguga

SEQ ID NO: 213394 - RNA, 1401 nt, Artificial Sequence
  derived and/or modified sequence opt5 from neuraminidase__InfluenzaB__AKA54781
augcugcccagcaccauccagacacucacgcuguuccuuaccuccggcggggugcugcucucucuguacgucagcgccucccuuucuuaucugcucuaccuggacauucugcucaaguuuccuagcacagagaucaccgcuccgacaaugccccuggauugcgccaacgcguccaauguucaagcugugaacagaucugccaccaaaggagugacauuccuucugccugaacccgaguggaccuauccucggcucagcugucccggcuccacguuucagaaggcccugcuuauuagcccucaccgcuucggggaaaccaaaggaaauucugcuccgcugaucauuagagagcccuuuaucgccugcggcccuaaggaauguaaacauuucgcucucacacacuacgccgcgcagcccgggggauauuacaacggcacccggggcgaccgcaauaagcugagacaucugaucuccgucaagcucgggaaaauuccuacaguggagaacagcaucuuucacauggccgcuuggucuggauccgccugccaugauggcaaggaguggaccuauauugggguugacggacccgauaauaacgcucugcuuaaaaucaaguacggcgaagccuacacggacacauaucacagcuacgcgaauaacauucugcggacccaggagucugccuguaauugcaucgggggaaacuguuaucucaugauuacagauggcuccgcuagcggcguguccgaaugccgcuuccugaaaaucagagaggggcggaucaugaaggagauuuuuccgaccggacgcacccaacacacagaagaguguacgugcggcuucgccucuaauaagaccaucgaaugugucugcagagacaacagcuacacagcuaaacggccuuuugugaaacuuaauguugagaccgauacagccgaaauucgccugaugugcaccaagacguaucucgacacacccagaccugaugacggguccaucaccggacccugugagagcaacggcgggaagggaucuggcggcauuaaagggggauucgugcaucagcggauggccuccaagaucggccgcugguacagcagaaccaugucuaaaacagagcggaaggggaugggacuguaugucaaguacaacggcgaucccugggcugacagcgacgcgcugaccuuuuccggggugauggugucuauggaggaaccuggcugguacagcuucggauucgaaaucaaagauaagaaaugcgacgucccguguauuggcaucgagaugguucacgaugggggaaaggaaacauggcauuccgccgcuacggccauuuauugccucaugggcagcgggcagcugcuuugggacaccgugacaggagugaauaugacccuguga

SEQ ID NO: 213395 - RNA, 1401 nt, Artificial Sequence
  derived and/or modified sequence opt5 from neuraminidase__InfluenzaB__AKA54783
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccuguucccugaacccgaguggaccuauccucgccuuuccugucccggcagcaccuuucagaaggcccugcucauuucuccucacagauucggggaaacgaaaggaaauuccgcuccgcugaucauucgggagcccuuuaucgccugcggcccuaaggaauguaaacauuucgcucuuacccacuacgccgcgcagcccgggggauauuacaacggcacacgcgaggacagaaauaagcugcggcaucucaucagcgugaagcugggcaaaauuccuaccguugagaacucuaucuuucacauggccgcuugguccgggagcgccugccaugauggacgcgaauggacauauauuggcguggacgggcccgauucuaaugcucugcucaagaucaaauacggagaggccuacaccgacacguaucacuccuacgcgaagaacauucugagaacacaggaaagcgccuguaauugcaucggcggggauuguuaucuuaugauuaccgacggaccggcuuccggcaucucugagugccgguuccugaaaauccgcgagggcagaauuaucaaggaaauuuuuccuacagggcgggucaagcacaccgaggaauguaccugcggauucgccagcaacaaaacaaucgagugugcuugccgcgauaauuccuacacggccaagagacccuuugugaaacucaacguugaaaccgacacagccgagauucggcugaugugcaccaagacauaucuugauaccccucgccccaaugacggcagcaucacggggcccugugagucugauggagacgaaggcuccgggggaaucaaaggcggcuucgugcaucaaagaauggcuagcaagauugggcggugguacucuagaacaaugagcaaaaccaagcgcaugggaaugggccuguaugucaaguacgacggggauccuuggaccgacuccgaggcgcucgcccugucuggagugauggugagcauggaggaaccgggcugguacuccuuuggguucgaaaucaaagauaagaaaugcgacguccccuguauuggcaucgagaugguucacgauggaggcaagacaaccuggcauagcgcugccacagccauuuauugccugauggggucuggacagcuccugugggacacggugaccggcgugaacaugacacuuuga

SEQ ID NO: 213396 - RNA, 1401 nt, Artificial Sequence
  derived and/or modified sequence opt5 from neuraminidase__InfluenzaB__AKA54785
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggaaacgaaggcuccgggggaaucaaaggcggcuuugugcaucaaagaauggcuagcaagauugggcggugguacucuagaacaaugagcaaaaccaagcgcaugggaaugggccucuaugucaaguacgacggggacccuuggaccgauuccgaggcgcuggcccugucuggagugauggugagcauggaggaaccgggcugguacuccuucggguuugaaaucaaagacaagaaaugcgauguccccuguauuggcaucgagaugguucacgacggaggcaagacaaccuggcauagcgcugccacagccauuuauugccucauggggucuggacagcugcuuugggauacggugaccggcgugaauaugacacuguga

SEQ ID NO: 213397 - RNA, 1401 nt, Artificial Sequence
  derived and/or modified sequence opt5 from neuraminidase__InfluenzaB__AKA54787
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccgccaaaggagugacacugcuucugcccgaaccugaguggaccuaucccagacucuccuguccuggcagcacauuccagaaggcucugcuuaucucuccccaucgguuuggggaaauuaaaggaaauuccgccccucugaucauccgcgagccguucauugcuugcggccccaccgaauguaagcacuuugcccucacgcauuacgcggcccagccugggggauauuacaacggcaccagagaggaccggaauaaacugcgccaccugaucagcgucaagcucggcaagauucccacaguggagaacucuaucuuccauauggcugccugguccgggagcgcuugccacgauggaaaagaauggaccuauauuggcguugacgggccugauucuaaugcccugcuuaagaucaaauacggagaggcguacacagacaccuaucacuccuacgccaagaacauucugagaacgcaagaaagcgcuuguaauugcaucggcggggauuguuaucucaugaucacagacggacccgccuccggcgugucugagugccgguuucugaaaauucgcgagggcagaaucauuaaggaaaucuucccgaccgggcgggucaagcauacagaggaauguaccugcggauuugcuagcaacaaaaccauugagugugccugccgcgauaauagauacacagccaagcggccuuucgugaaacuuaacguugaaacggacaccgcugagauccgccugaugugcacagagaccuaucucgauacacccagaccuaaugacggcuccaucaccgggcccugugaaagcgauggagacaagggcucugggggaauuaaaggcggcuuugugcaccagcggauggcguccaagaucgggcgcugguacagcagaacgaugucuaaaacaaagcggaugggaaugggccuguaugucaaguacgacggggaucccuggaccgacagcgaggcccuggcucucuccggagugauggugucuauggaggaaccuggcugguacagcuucggguuugaaauuaaagauaagaaaugcgacgucccguguaucggcauugagaugguucaugauggaggcaagaccacauggcacuccgccgccaccgcuaucuauugccugauggggagcggacagcuucugugggacacagugacgggcguggauauggcccucuga

SEQ ID NO: 213398 - RNA, 1401 nt, Artificial Sequence
  derived and/or modified sequence opt5 from neuraminidase__InfluenzaB__AKA54789
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugagcauggaggaaccgggcugguacuccuucggguuugaaaucaaagauaagaaaugcgacguccccuguauuggcaucgagaugguucacgauggaggcaagacaaccuggcauagcgcugccacagccauuuauugccucauggggucuggacagcugcuuugggacacggugaccggcgugaacaugacacuguga

SEQ ID NO: 213399 - RNA, 1401 nt, Artificial Sequence
  derived and/or modified sequence opt5 from neuraminidase__InfluenzaB__AKA54791
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugcucaagccgugaaccggagcgccacaaaaggagugacaccccugcuuccugaacccgaguggaccuauccucgccuguccugucccggcagcaccuuccagaaggcucuccugauuucuccucacagauuuggggaaacgaaaggaaauuccgccccgcuuaucauucgggagcccuucaucgcuugcggcccuaaggaauguaaacauuuugcccugacccacuacgcggcccagcccgggggauauuacaacggcacacgcgaggacagaaauaagcuccggcaucugaucagcgucaagcugggcaaaauuccuaccguggagaacucuaucuuccacauggcugccugguccgggagcgcuugccaugauggacgcgaauggacauauauuggcguugacgggcccgauucuaaugcccuccugaagaucaaauacggagaggcguacaccgacacguaucacuccuacgccaagaacauucuuagaacacaggaaagcgcuuguaauugcaucggcggggauuguuaucugaugauuaccgacggaccggccuccggcaucucugagugccgguuucucaaaauccgcgagggcagaauuaucaaggaaauuuucccuacagggcgggugaagcacaccgaggaauguaccugcggauuugcuagcaacaaaacaaucgagugugccugccgcgauaauuccuacacggccaagagacccuucgucaaacugaacguggaaaccgacacagcugagauucggcuuaugugcaccaagacauaucuggauaccccucgccccaaugacggcagcaucacggggcccugugagucugauggagacgaaggcuccgggggaaucaaaggcggcuuuguucaucaaagaauggcgagcaagauugggcggugguacucuagaacaaugagcaaaaccaagcgcaugggaaugggccucuaugugaaguacgacggggauccuuggaccgacuccgaggcccuggcucugucuggagucauggugagcauggaggaaccgggcugguacuccuucggguuugaaaucaaagauaagaaaugcgacgugcccuguauuggcaucgagaugguccacgauggaggcaagacaaccuggcauagcgccgccacagcuauuuauugccucauggggucuggacagcugcuuugggacacgguuaccggcgugaacaucacacuguga

SEQ ID NO: 213400 - RNA, 1401 nt, Artificial Sequence; identical to SEQ ID NO: 213397
  derived and/or modified sequence opt5 from neuraminidase__InfluenzaB__AKA54793

SEQ ID NO: 213401 - RNA, 1401 nt, Artificial Sequence; identical to SEQ ID NO: 213397
  derived and/or modified sequence opt5 from neuraminidase__InfluenzaB__AKA54795

SEQ ID NO: 213402 - RNA, 1401 nt, Artificial Sequence; identical to SEQ ID NO: 213398
  derived and/or modified sequence opt5 from neuraminidase__InfluenzaB__AKA54797

SEQ ID NO: 213403 - RNA, 1401 nt, Artificial Sequence
  derived and/or modified sequence opt5 from neuraminidase__InfluenzaB__AKA54799
augcugcccagcaccauccagacacucacgcuguuccuuaccuccggcggggugcugcucucucuguacgucagcgccucccuuucuuaucugcucuacagcgacauucugcugaaguuuucccaaacagagaucaccgcuccuauuaugccgcucgauugcgccaacgcgucuaauguucaggcugugaaccacagcgccgccaaaggagugacacugcuucugcccgaaccugaguggaccuaucccagacucuccuguccuggcagcacauuccagaaggcucugcuuaucucuccccaucgguuuggggaaauuaaaggaaauuccgccccucugaucauccgcgagccguucauugcuugcggccccaccgaauguaagcacuuugcccucacgcauuacgcggcccagccugggggauauuacaacggcaccagagaggaccggaauaaacugcgccaccugaucagcgucaagcucggcaagauucccacaguggagaacucuaucuuccauauggcugccugguccgggagcgcuugccacgauggaaaagaauggaccuauauuggcguugacgggccugauucuaaugcccugcuuaagaucaaauacggagaggcguacacagacaccuaucacuccuacgaaaagaacauucugagaacgcaagagagcgccuguaauugcaucggcggggauuguuaucucaugaucacagacggacccgcuuccggcgugucugagugccgguuucugaaaauucgcgaaggcagaaucauuaaggagaucuucccgaccgggcgggucaagcauacagaagaguguaccugcggauuugccagcaacaaaaccauugaaugugcuugccgcgauaauagauacacagccaagcggccuuucgugaaacuuaacguugagacggacaccgccgagauccgccugaugugcacagaaaccuaucucgauacacccagaccuaaugacggcuccaucaccgggcccugugagagcgauggagacaagggcucugggggaauuaaaggcggcuuugugcaccagcggauggcuuccaagaucgggcgcugguacagcagaacgaugucuaaaacaaagcggaugggaaugggccuguaugucaaguacgacggggaucccuggaccgacagcgaagcgcuggcccucuccggagugauggugucuauggaggaaccuggcugguacagcuucggguuugagauuaaagauaagaaaugcgacgucccguguaucggcauugagaugguucaugauggaggcaagaccacauggcacuccgcugccaccgccaucuauugccugauggggagcggacagcuucugugggacacagugacgggcguggauauggcucucuga

SEQ ID NO: 213404 - RNA, 1401 nt, Artificial Sequence; identical to SEQ ID NO: 213398
  derived and/or modified sequence opt5 from neuraminidase__InfluenzaB__AKA54801

SEQ ID NO: 213405 - RNA, 1401 nt, Artificial Sequence
  derived and/or modified sequence opt5 from neuraminidase__InfluenzaB__AKA54803
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaauggagucacaccccugcuuccugaacccgaguggaccuauccucgccuguccugucccggcagcaccuuccagaaagcccuccugauuucuccucacagauuuggggaaacgaagggaaacuccgcuccgcuuaucauucgggagcccuucaucgccugcggcccuaaagaauguaagcauuuugcucugacccacuacgccgcgcagcccgggggauauuacaauggcacacgcgaggacagaaacaaacuccggcaucugaucagcgugaagcugggcaagauuccuaccguugaaaauucuaucuuccacauggccgcuugguccgggagcgccugccaugauggacgcgaauggacauauauuggcguggacgggcccgauucuaacgcucuccugaaaaucaaguacggagaggccuacaccgacacguaucacuccuacgcgaaaaauauucuuagaacacaggaaagcgccuguaacugcaucggcggggauuguuaucugaugauuaccgacggaccggcuuccggcaucucugagugccgguuucucaagauccgcgagggcagaauuaucaaagaaauuuucccuacagggcgggucaagcacaccgaggaauguaccugcggauuugccagcaauaagacaaucgagugugcuugccgcgauaacuccuacacggccaaaagacccuucgugaagcugaauguugaaaccgacacagccgagauucggcuuaugugcaccaaaacauaucuggauaccccucgccccaacgacggcagcaucacggggcccugugagucugauggagacgaaggcuccgggggaaucaagggcggcuuugugcaucaaagaauggcuagcaaaauugggcggugguacucuagaacaaugagcaagaccaaacgcaugggaaugggccucuaugucaaguacgacggggauccuuggaccgacuccgaggcgcuggcccugucuggagugauggugagcauggaggagccgggcugguacuccuucggguuugaaaucaaggauaaaaagugcgacguccccuguauuggcaucgagaugguucacgauggaggcaaaacaaccuggcauagcgcugccacagccauuuauugccucauggggucuggacagcugcuuugggacacggugaccggcgugaauaugacacuguga

SEQ ID NO: 213406 - RNA, 1401 nt, Artificial Sequence; identical to SEQ ID NO: 213398
  derived and/or modified sequence opt5 from neuraminidase__InfluenzaB__AKA54805

SEQ ID NO: 213407 - RNA, 1401 nt, Artificial Sequence
  derived and/or modified sequence opt5 from neuraminidase__InfluenzaB__AKA54807
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugagcauggaggaaccgggcugguacuccuucggguuugaaaucaaagauaagaaaugcgacguccccuguauuggcaucgagaugguucacgauggaggcaagacaaccuggcauagcgcugccacagccauuuauugccucauggggucuggacagcugcuuugggacacggugaccggcgugaacaucacacuguga

SEQ ID NO: 213408 - RNA, 1401 nt, Artificial Sequence
  derived and/or modified sequence opt5 from neuraminidase__InfluenzaB__AKA54809
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuuucaagauugggcggugguacagcagaacaaugucuaaaaccaagcgcaugggaaugggccucuaugucaaguacgacggggauccuuggaccgacagcgaggcgcuggcccuguccggagugauggugucuauggaggaaccgggcugguacagcuuuggguucgaaaucaaagauaagaaaugcgacguccccuguauuggcaucgagaugguucacgauggaggcaagacaaccuggcauuccgcugccacagccauuuauugccucauggggagcggacagcugcuuugggacacggugaccggcgugaacaugacacuguga

SEQ ID NO: 213409 - RNA, 1401 nt, Artificial Sequence; identical to SEQ ID NO: 213398
  derived and/or modified sequence opt5 from neuraminidase__InfluenzaB__AKA54811

SEQ ID NO: 213410 - RNA, 1401 nt, Artificial Sequence
  derived and/or modified sequence opt5 from neuraminidase__InfluenzaB__AKA54813
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugagcaucgaggaaccgggcugguacuccuucggguuugaaauuaaagauaagaaaugcgacguccccuguaucggcauugagaugguucacgauggaggcaagacaaccuggcauagcgcugccacagccaucuauugccucauggggucuggacagcugcuuugggacacggugaccggcgugaacaugacacuguga

SEQ ID NO: 213411 - RNA, 1401 nt, Artificial Sequence; identical to SEQ ID NO: 213398
  derived and/or modified sequence opt5 from neuraminidase__InfluenzaB__AKA54815

SEQ ID NO: 213412 - RNA, 1401 nt, Artificial Sequence
  derived and/or modified sequence opt5 from neuraminidase__InfluenzaB__AKA54817
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugagcauggaggaaccgggcugguacuccuucggguuugaaaucaaagauaagaaaugcgacguccccuguauuggcguugagauggugcacgauggaggcaagacaaccuggcauagcgcugccacagccaucuauugccucauggggucuggacagcugcuuugggacacggugaccggcgucaacaugacacuguga

SEQ ID NO: 213413 - RNA, 1401 nt, Artificial Sequence; identical to SEQ ID NO: 213398
  derived and/or modified sequence opt5 from neuraminidase__InfluenzaB__AKA54819

SEQ ID NO: 213414 - RNA, 1401 nt, Artificial Sequence; identical to SEQ ID NO: 213398
  derived and/or modified sequence opt5 from neuraminidase__InfluenzaB__AKA54821

SEQ ID NO: 213415 - RNA, 1401 nt, Artificial Sequence; identical to SEQ ID NO: 213398
  derived and/or modified sequence opt5 from neuraminidase__InfluenzaB__AKA54823

SEQ ID NO: 213416 - RNA, 1401 nt, Artificial Sequence; identical to SEQ ID NO: 213398
  derived and/or modified sequence opt5 from neuraminidase__InfluenzaB__AKA54825

SEQ ID NO: 213417 - RNA, 1401 nt, Artificial Sequence; identical to SEQ ID NO: 213398
  derived and/or modified sequence opt5 from neuraminidase__InfluenzaB__AKA54827

SEQ ID NO: 213418 - RNA, 1401 nt, Artificial Sequence
  derived and/or modified sequence opt5 from neuraminidase__InfluenzaB__AKA54829
augcugcccagcaccauccagacacucacgcuguuccuuaccuccggcggggugcugcucucucuguacgucagcgccucccuuucuuaucugcucuacagcgacauucugcugaagcucuccagaacagagguuaccgcuccuaucaugccgcuggauugcgccaacgcgucuaaugugcaagcugugaaccggagcgccacaaaaggagucacaccccuucugccugaacccgaguggaccuauccucgccucuccugucccggcagcaccuuucagaagacgcugcuuauuucuccucacagauucggggaaaccaaaggaaauuccgccccgcugaucauucgggagcccuuuaucgcuugcggcccuaaggaauguaaacauuucgcccucacacacuacgcugcccagcccgggggauauuacaacggcacccgcgaggacagaaauaagcugcggcaucugaucagcgugaagcucggcaaaauuccuacaguugagaacucuaucuuucacauggcggccugguccgggagcgcuugccaugauggacgcgaauggaccuauauuggcguggacgggcccgauucuaaugcccugcuuaagaucaaauacggagaggcuuacacggacacauaucacuccuacgccaagaacauucugagaacccaggaaagcgcguguaauugcaucggcggggauuguuaucucaugauuacagacggaccggccuccggcaucucugagugccgguuccugaaaauccgcgagggcagaauuaucaaggaaauuuuuccuaccgggcgggucaagcacaccgaggaauguacaugcggauucgcuagcaacaaaacgaucgagugugccugccgcgauaauuccuacaccgcuaagagacccuuugugaaacuuaacguugaaacagacaccgccgagauucggcugaugugcacaaagaccuaucucgauacgccucgccccaaugacggcagcaucacagggcccugugagucugauggagacgaaggcuccgggggaaucaaaggcggcuucgugcaucaaagaauggccagcaagauugggcggugguacucuagaaccaugagcaaaaccaagcgcaugggaaugggccuguaugucaaguacgacggggauccuuggacagacuccgaggcucuggcgcucucuggagugauggugagcauggaggaaccgggcugguacuccuuuggguucgaaaucaaagauaagaaaugcgacguccccuguauuggcaucgagaugguucacgauggaggcaagaccacauggcauagcgccgcuacggccauuuauugccugauggggucuggacagcuucugugggacaccgugacaggcgugaacaugacccucuga

SEQ ID NO: 213419 - RNA, 1401 nt, Artificial Sequence
  derived and/or modified sequence opt5 from neuraminidase__InfluenzaB__AKA54831
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcaggauucuaaugcucuccugaagaucaaauacggagaggccuacaccgacacguaucacuccuacgcgaagaacauucuuagaacacaagaaagcgccuguaauugcaucggcggggauuguuaucugaugauuaccgacggacccgcuuccggcaucucugagugccgguuucucaaaauccgcgagggcagaauuaucaaggaaauuuucccgacagggcgggucaagcacaccgaggaauguaccugcggauuugccagcaacaaaacaaucgagugugcuugccgcgauaauuccuacacggccaagagaccuuucgugaaacugaacguugaaaccgacacagccgagauucggcuuaugugcaccaagacauaucuggauacgccccgcccuaaugacggcagcaucaccgggcccugugagucugauggagacgaaggcuccgggggaaucaaaggcggcuuugugcaucagagaauggcuagcaagauugggcggugguacucuagaacaaugagcaaaaccaagcgcaugggaaugggccucuaugucaaguacgacggggaucccuggaccgacuccgaggcgcuggcccugucuggagugauggugagcauggaggaaccuggcugguacuccuucggguuugaaaucaaagauaagaaaugcgacgucccguguauuggcaucgagaugguucacgauggaggcaagacaaccuggcauagcgcugccacagccauuuauugccucauggggucuggacagcugcuuugggacacggugaccggcgugaacaugacacuguga

SEQ ID NO: 213420 - RNA, 1401 nt, Artificial Sequence; identical to SEQ ID NO: 213398
  derived and/or modified sequence opt5 from neuraminidase__InfluenzaB__AKA54833

SEQ ID NO: 213421 - RNA, 1401 nt, Artificial Sequence
  derived and/or modified sequence opt5 from neuraminidase__InfluenzaB__AKA54837
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaauggaaacuccgcuccgcugaucgucagagagcccuucauugccugcggcccuaaugaauguaaacauuuugcucucacacacuacgccgcgcagcccgggggauauuacaacggcacccggggcgaccgcaauaagcugagacaucugaucagcgugaaacucgggaagaucccuacaguugagaacucuauuuuccacauggccgcuugguccggaagcgccugccaugauggcaaggaguggaccuauaucgggguggacggacccgauaauaacgcucugcuuaaagucaaguacggcgaagccuacacggacacauaucacucuuacgcgaauaaaauucugcggacccaggaguccgccuguaacugcaucgggggaaauuguuaucucaugauuacagauggcagcgcuuccggcgugucugaaugccgcuuucugaagaucagagaggggcggauuaucaaagagaucuucccgaccggacgcguuaagcacaccgaagaguguacaugcggcuuugccagcaacaagacgauugaaugugcuugcagagacaaucgguacaccgccaaacgcccuuucgugaaacuuaacgucgagacagauaccgccgaaaucagacugaugugcacagacaccuaucucgauacgccccggccuaacgacggguccauuacaggacccugugagagcgauggcaaugaggggucuggaggcaucaagggcggguuugugcaucaacgcaugaaguccaaaauuggaagaugguacagccggaccaugucuaagaccgaaagaaugggcauggggcuguaugugaaauacgacggagaccccugggcugauagcgacgcgcuggccuucuccggcgucaugguuucuaugaaggagccugggugguacagcuuuggcuucgaaaucaaggauaaaaagugcgacgugccguguaucggaauugagauggugcacgauggcgggaaagaaacauggcauuccgcugccaccgccaucuauugccucaugggaagcggccagcugcuuugggacacagucacggggguggauauggcucuguga

SEQ ID NO: 213422 - RNA, 1401 nt, Artificial Sequence
  derived and/or modified sequence opt5 from neuraminidase__InfluenzaB__AKA54839
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaagaagugacacugcuucugccugagcccgaauggaccuauccucggcucuccugucccggaagcacguuccagaaggcccugcuuauuucuccucaccgcuuuggcgagaccaaaggaaauuccgcuccgcugaucauuagagaacccuucaucgccugcgggccuaacgaguguaagcauuuugcucucacacacuacgccgcgcagcccggcggguauuacaauggaacccggggcgaccgcaacaaacugagacaucugaucagcgucaagcucggcaagauuccuacaguggaaaauucuaucuuccacauggccgcuugguccgggagcgccugccaugauggaaaagaguggaccuauauuggcguugacgggcccgauaacaaugcucugcuuaaggugaaauacggagaggccuacacggacacauaucacucuuacgcgaacaagauccugcggacccaggaauccgccuguaauugcauuggcgggaacuguuaucucaugaucacagauggaagcgcuuccggcgucucugagugccgcuuucugaaaauuagagagggccggaucaucaaggaaauuuucccgaccgggcgcgugaagcacaccgaggaauguacaugcggauuugccagcaauaaaacgaucgagugugcuugcagagacaaccgguacaccgccaagcgcccuuucguuaaacuuaauguggaaacagauaccgccgagauuagacugaugugcacagacaccuaucucgauacgccccggccuaacgacggcuccaucacagggcccugugagagcgauggagacaagggcucugggggaauuaaaggcggcuuuguccaucaacgcaugaaguccaaaaucgggagaugguacagccggaccaugucuaagaccgaaagaaugggaaugggccuguaugugaaguacgacggggaucccugggcugacagcgaugcgcuggccuucuccggagugauggucucuaugaaagagccuggcugguacagcuuuggguucgaaaucaaggacaaaaagugcgauguuccguguauuggcaucgagauggugcacgacggaggcaaagaaacauggcauuccgcugccaccgccauuuauugccucauggggagcggacagcugcuuugggauacagugacgggcgucgacauggcucuguga

SEQ ID NO: 213423 - RNA, 1401 nt, Artificial Sequence
  derived and/or modified sequence opt5 from neuraminidase__InfluenzaB__AKA54841
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacgaggggucuggaggcauuaagggcggguuuguccaucaacgcaugaaauccaagaucggaagaugguacagccggaccaugucuaaaaccgaaagaaugggcauggggcuguaugugaaguacgacggagaucccugggcugacagcgaugcgcuggccuucuccggcgugauggucucuguuaaggagccugggugguacagcuuuggcuucgaaaucaaagacaagaaaugcgaugugccguguauuggaaucgagauggugcacgacggcgggaaggaaacauggcauuccgcugccaccgccauuuauugccucaugggaagcggccagcugcuuugggauacagucacggggguggacaucgcucuguga

SEQ ID NO: 213424 - RNA, 1401 nt, Artificial Sequence
  derived and/or modified sequence opt5 from neuraminidase__InfluenzaB__AKA54843
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacgaggggucuggaggcauuaagggcggguuuguccaucaacgcaugaaauccaagaucggaagaugguacagccggaccaugucuaaaaccgaaagaaugggcauggggcuguaugugaaguacgacggagaucccugggcugacagcgaugcgcuggccuucuccggcgugauggucucuguuaaggagccugggugguacagcuuuggcuucgaaaucaaagacaagaaaugcgaugugccguguauuggaaucgagauggugcacgacggcgggaaggaaacauggcauuccgcugccaccgccauuuauugccucaugggaagcggccagcugcuuugggauacagucacggggguggacauggcucuguga

SEQ ID NO: 213425 - RNA, 1401 nt, Artificial Sequence
  derived and/or modified sequence opt5 from neuraminidase__InfluenzaB__AKA54845
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaauggaaacuccgcuccgcugaucauuagagagcccuucaucgccugcggcccuaaugaauguaaacauuuugcucucacacacuacgccgcgcagcccgggggauauuacaacggcacccggggcgaccgcaauaagcugagacaucugaucagcgucaaacucgggaagauuccuacaguggagaacucuaucuuccacauggccgcuugguccggaagcgccugccaugauggcaaggaguggaccuauauugggguugacggacccgauaauaacgcucugcuuaaagugaaguacggcgaagccuacacggacacauaucacucuuacgcgaauaaaauccugcggacccaggaguccgccuguaacugcauugggggaaauuguuaucucaugaucacagauggcagcgcuuccggcgucucugaaugccgcuuucugaagauuagagaggggcggaucaucaaagagauuuucccgaccggacgcgugaagcacaccgaagaguguacaugcggcuuugccagcaacaagacgaucgaaugugcuugcagagacaaucgguacaccgccaaacgcccuuucguuaaacuuaacguggagacagauaccgccgaaauuagacugaugugcacagacaccuaucucgauacgccccggccuaacgacggguccaucacaggacccugugagagcgauggcgacgaggggucuggaggcauuaagggcggguuuguccaucaacgcaugaaguccaaaaucggaagaugguacagccggaccaugucuaagaccgaaagaaugggcauggggcuguaugugaaauacgacggagaucccugggcugacagcgaugcgcuggccuucuccggcgugauggucucuaugaaggagccugggugguacagcuuuggcuucgaaaucaaggacaaaaagugcgauguuccguguauuggaaucgagauggugcacgacggcgggaaagaaacauggcauuccgcugccaccgccauuuauugccucaugggaagcggccagcugcuuugggauacagugacgggggucgacauggcucuguga

SEQ ID NO: 213426 - RNA, 1401 nt, Artificial Sequence; identical to SEQ ID NO: 213230
  derived and/or modified sequence opt5 from neuraminidase__InfluenzaB__AKA54847

SEQ ID NO: 213427 - RNA, 1401 nt, Artificial Sequence
  derived and/or modified sequence opt5 from neuraminidase__InfluenzaB__AKA54849
augcugcccagcaccauccagacacucacgcuguuccuuaccuccggcggggugcugcucucucuguacgucagcgccucccuuucuuaucugcucuacagcgacauucugcugaaguuuuccucuacagagaucaccgcuccuacaaugccgcucgauugcgccaacgcgagcaauguucaagcugugaacagauccgccaccaaaggagugacacugcuucugcccgaaccugaguggaccuauccccggcucagcuguccuggcucuacguuccagaaggcccugcuuauuagcccccaccgcuuuggggaaaccaauggaaacuccgcuccucugaucauuagagagccguucaucgccugcggccccaaugaauguaaacauuuugcucucacacacuacgccgcgcagccugggggauauuacaacggcacccggggcgaccgcaauaagcugagacaucugaucucugucaaacucgggaagauucccacaguggagaacuccaucuuccacauggccgcuuggagcggaucugccugccaugauggcaaggaguggaccuauauugggguugacggaccugauaauaacgcucugcuuaaagugaaguacggcgaagccuacacggacacauaucacuccuacgcgaauaaaauccugcggacccaggagagcgccuguaacugcauugggggaaauuguuaucucaugaucacagauggcuccgcuucuggcgucagcgaaugccgcuuucugaagauuagagaggggcggaucaucaaagagauuuuccccaccggacgcgugaagcacaccgaagaguguacaugcggcuuugccuccaacaagacgaucgaaugugcuugcagagacaaucgguacaccgccaaacgcccguucguuaagcugaacguggagacagauaccgccgaaauuagacuuaugugcacagacaccuaucucgauacgccucggcccaacgacgggagcaucacaggaccuugugagucugauggcgacgaagggggaggcggcauuaaagggggauuuguccaucaacgcaugaaguccaaaaucggcagaugguacagccggaccaugucuaagaccgagagaauggggaugggacuguaugugaaauacgacggcgaucccugggcugacagcgaugcgcuggccuucuccggggugauggucucuaugaaggagcccggcugguacagcuuuggauucgaaaucaaggacaaaaagugcgauguuccuuguauuggcaucgagauggugcacgacgggggaaaagaaacauggcauuccgcugccaccgccauuuauugccucaugggcagcgggcagcugcuuugggauacagugacgggagucgacauggcucuguga

SEQ ID NO: 213428 - RNA, 1401 nt, Artificial Sequence
  derived and/or modified sequence opt5 from neuraminidase__InfluenzaB__AKA54851
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacaucgacacguaucacucuuacgcgaacaagauucugcggacacaggaguccgccuguaauugcaucgggggaaacuguuaucucaugauuaccgauggcagcgcuuccggcgucucugaaugccgcuuucugaaaaucagagaggggcggaucauuaaggagaucuucccgacaggacgcgugaagcacaccgaagaguguaccugcggcuuugccagcaauaaaacaauugaaugugcuugcagagacaaccgguacacggccaagcgcccuuucguuaaacuuaauguggagaccgauacagccgaaaucagacugaugugcaccgacacauaucucgauacgccccggccuaacgacggguccauuaccggacccugugagagcgauggcgacaaggggucuggaggcaucaaaggcggguuuguccaucaacgcaugaaguccaaaaucggaagaugguacagccggacaaugucuaagaccgagagaaugggcauggggcuguaugugaaguacgacggagaucccugggcugacagcgaugcgcuggccuucuccggcgugauggucucuaugaaagaaccugggugguacagcuuuggcuucgagauuaaggacaaaaagugcgauguuccguguaucggaauugaaauggugcacgacggcgggaaagagaccuggcauuccgcugccacagccaucuauugccucaugggaagcggccagcugcuuugggauaccgugacaggggucgacauggcucuguga

SEQ ID NO: 213429 - RNA, 1401 nt, Artificial Sequence
  derived and/or modified sequence opt5 from neuraminidase__InfluenzaB__AKA54853
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacgaggggucuggaggcgucaagggcggguuugugcaucaacgcaugaaauccaagauuggaagaugguacagccggaccaugucuaaaaccgaaagaaugggcauggggcuguaugugaaguacgacggagaucccugggcugacagcgaugcgcuggccuucuccggcgucaugguuucugugaaggagccugggugguacagcuuuggcuucgaaaucaaagacaagaaaugcgaugugccguguaucggaauugagaugguccacgacggcgggaaggaaacauggcauuccgcugccaccgccaucuauugccucaugggaagcggccagcugcuuugggauacagugacggggguugacauggcucuguga

SEQ ID NO: 213430 - RNA, 1401 nt, Artificial Sequence
  derived and/or modified sequence opt5 from neuraminidase__InfluenzaB__AKA54855
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuugauguggagacagacaccgccgaaauuagacugaugugcacagauaccuaucucgacacgccccggccuaaugauggguccaucacaggacccugugagagcgacggcgacaaggggucuggaggcauuaaaggcggguuuguccaucaacgcaugaaguccaaaaucggaagaugguacagccggaccaugucuaagaccgagagaaugggcauggggcuguaugugaaguacgauggagaccccugggcugauagcgacgcgcuggccuucuccggcgugauggucucuaugaaagaaccugggugguacagcuuuggcuucgagaucaaggauaaaaagugcgacguuccguguauuggaaucgaaauggugcacgauggcgggaaagagacauggcauuccgcugccaccgccauuuauugccucaugggaagcggccagcugcuuugggacacagugacgggggucgauauggcucuguga

SEQ ID NO: 213431 - RNA, 1401 nt, Artificial Sequence
  derived and/or modified sequence opt5 from neuraminidase__InfluenzaB__AKT07927
augcccccuagcaccauccagacacugacccucuuccugacguccggcggggugcuucugucucucuacgucagcgccucccugucuuaucuucuguacagcgacauucuccugaaguuuuccccgacagagaucaccgcucccacaaugccucuggauugcgccaacgcgucuaauguucaagcugugaacagaagcgccaccaaaggagugacacuccugcuucccgaaccugaguggaccuauccccggcuguccuguccuggcagcacguuccagaaggcccuccugauuucuccgcaccgcuuuggggaaaccagaggaaauuccgcuccccuuaucauucgggagccuuucaucgccugcggccccaacgaauguaaacauuuugcucugacacacuacgccgcgcagccugggggauauuacaauggcacccgcggcgacagaaacaagcuccggcaucugaucagcgucaaacuggggaagauucccacaguggaaaauucuaucuuccacauggccgcuugguccggaagcgccugccaugauggcaaggaguggaccuauauugggguugacggaccggauaacaaugcucuccugaaagugaaguacggcgaggccuacacggacacauaucacucuuacgcgaacaaaauccuucgcacccaggaguccgccuguaauugcauugggggaaacuguuaucugaugaucacagauggcagcgcuuccggcgucucugaaugcagauuucucaagauucgggaggggcgcaucaucaaagagauuuucccuaccggaagagugaagcacaccgaagaguguacaugcggcuuugccagcaauaagacgaucgaaugugcuugccgggacaacuccuacaccgccaaacgccccuucguuaagcugaauguggagacagauaccgccgaaauuagacuuaugugcacagacaccuaucuggauacgccucggcccaacgacgggagcaucacaggacccugugagucugauggcgacaaaggguccggaggcauuaagggcggguuuguccaucaacgcauggagagcaaaaucggaagaugguacucucggaccaugagcaagaccgaaagaaugggcauggggcucuaugugaaauacgacggagauccuuggacagacuccgaugcucuggcguucggcggggugauggucucuaugaaggagccgggcugguacagcuuuggauucgaaaucaaggacaaaaagugcgauguucccuguauuggcaucgagauggugcacgacgggggaaaagaaaccuggcauuccgccgcuacagccauuuauugccugaugggcagcgggcagcuccugugggauacggugaccggagucgacauggcccuuuga

SEQ ID NO: 213432 - RNA, 1401 nt, Artificial Sequence; identical to SEQ ID NO: 212143
  derived and/or modified sequence opt5 from neuraminidase__InfluenzaB__AKT07931

SEQ ID NO: 213433 - RNA, 1401 nt, Artificial Sequence
  derived and/or modified sequence opt5 from neuraminidase__InfluenzaB__AKT07933
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugaccuuccugcuuccugaacccgaguggacauauccucggcuguccugucccggcagcaccuuucagaaggcucuccugauuucuccucaccgcuucggggaaacgaaaggaaauuccgccccgcuuaucauuagagagcccuuuaucgcuugcggcccuaacgaauguaagcauuucgcccugacccacuacgcggcccagcccgggggauauuacaauggcacacggggcgaccgcaacaaacucagacaucugaucagcgucaagcuggggaagauuccuaccguggaaaauucuaucuuucacauggcugccugguccggaagcgcuugccaugauggcaaagaguggacauauauugggguugacggacccgauaacaaugcccuccugaaggugaaauacggcgaggcguacaccgacacguaucacucuuacgccaacaagauccuucggacacaggaguccgcuuguaauugcauugggggaaacuguuaucugaugaucaccgauggcagcgccuccggcgucucugaaugccgcuuccucaaaauuagagaggggcggaucaucaaggagauuuuuccgacaggacgcgugaagcacaccgaagaguguaccugcggcuucgcuagcaauaaaacaaucgaaugugccugcagagacaacuccuacacggccaagcggccuuuuguuaaacugaauguggagaccgauacagcugaaauucgccuuaugugcaccgacacauaucuggauacccccagaccuaacgacgggagcaucacgggacccugugagucugauggcgacaagggguccggaggcauuaaaggcggguucguccaucaacggauggagagcaagaucggacgcugguacucuagaacaaugagcaaaaccgaacggaugggcauggggcucuaugugaaguacgacggagaucccugggcggacuccgaugcccuggcuuuuucuggcgugauggucagcaugaaggagccugggugguacuccuucggcuucgaaaucaaagacaagaaaugcgauguuccguguauuggaaucgagauggugcacgacggcgggaaggaaaccuggcauagcgccgccacagcuauuuauugccugaugggaucuggccagcuccugugggauaccgugacaggggucgacauggcccuuuga

SEQ ID NO: 213434 - RNA, 1401 nt, Artificial Sequence; identical to SEQ ID NO: 212143
  derived and/or modified sequence opt5 from neuraminidase__InfluenzaB__AKT07935

SEQ ID NO: 213435 - RNA, 1401 nt, Artificial Sequence; identical to SEQ ID NO: 212143
  derived and/or modified sequence opt5 from neuraminidase__InfluenzaB__AKT07937

SEQ ID NO: 213436 - RNA, 1401 nt, Artificial Sequence; identical to SEQ ID NO: 211985
  derived and/or modified sequence opt5 from neuraminidase__InfluenzaB__AKT07939

SEQ ID NO: 213437 - RNA, 1401 nt, Artificial Sequence; identical to SEQ ID NO: 212143
  derived and/or modified sequence opt5 from neuraminidase__InfluenzaB__AKT07941

SEQ ID NO: 213438 - RNA, 1401 nt, Artificial Sequence; identical to SEQ ID NO: 212143
  derived and/or modified sequence opt5 from neuraminidase__InfluenzaB__AKT07945

SEQ ID NO: 213439 - RNA, 1401 nt, Artificial Sequence
  derived and/or modified sequence opt5 from neuraminidase__InfluenzaB__AKT07947
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccggccaugccccucgauugcgcgaacgcuucuaauguucaagccgugaacagaagcgccacaaaaggagugacccugcuucugccugaacccgaguggacauauccucggcucuccugucccggcagcaccuuccagaaggcucugcuuauuucuccucaccgcuuuggggaaacgaaaggaaauuccgccccgcugaucauuagagagcccuucaucgcuugcggcccuaacgaauguaagcauuuugcccucacccacuacgcggcccagcccgggggauauuacaauggcacacggggcgaccgcaacaaacugagacaucugaucagcgucaagcucgggaagauuccuaccguggaaaauucuaucuuccacauggcugccugguccggaagcgcuugccaugauggcaaagaguggacauauauugggguugacggacccgauaacaaugcccugcuuaaggugaaauacggcgaggcguacaccgacacguaucacucuuacgccaacaagauccugcggacacaggaguccgcuuguaauugcauugggggaaacuguuaucucaugaucaccgauggcagcgccuccggcgucucugaaugccgcuuucugaaaauuagagaggggcggaucaucaaggagauuuucccgacaggacgcgugaagcacaccgaagaguguaccugcggcuuugcuagcaauaaaacaaucgaaugugccugcagagacaacuccuacacggccaagcggccuuucguuaaacuuaauguggagaccgauacagcugaaauucgccugaugugcaccgacacauaucucgauacccccagaccuaacgacgggagcaucacgggacccugugagucugauggcgacaagggguccggaggcauuaaaggcggguuuguccaucaacggauggagagcaagaucggacgcugguacucuagaacaaugagcaaaaccgaacggaugggcauggggcuguaugugaaguacgacggagaucccugggcggacuccgaugcccuggcuuucucuggcgugauggucagcaugaaggagccugggugguacuccuuuggcuucgaaaucaaagacaagaaaugcgauguuccguguauuggaguggacauggugcacgauugcggcaaggagaccuggcauagcgccgccacagcuaucuauugucucauggggucuggacagcugcuuugggacaccgucacaggcguggauauggcccuguga

SEQ ID NO: 213440 - RNA, 1401 nt, Artificial Sequence; identical to SEQ ID NO: 213398
  derived and/or modified sequence opt5 from neuraminidase__InfluenzaB__AKU40585

SEQ ID NO: 213441 - RNA, 1401 nt, Artificial Sequence; identical to SEQ ID NO: 213398
  derived and/or modified sequence opt5 from neuraminidase__InfluenzaB__AKU40596

SEQ ID NO: 213442 - RNA, 1401 nt, Artificial Sequence
  derived and/or modified sequence opt5 from neuraminidase__InfluenzaB__AKU40607
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucacaccgcucgauugcgccaacgcgucuaaugcucaagccgugaaccggagcgccaccaaaggagugacaccccugcuuccugaacccgaguggaccuauccucgccuguccugucccggcagcacguuccagaaggcucuccugauuucuccucacagauuuggggaaaccaaaggaaauuccgccccgcuuaucauucgggagcccuucaucgcuugcggcccuaaggaauguaaacauuuugcccugacacacuacgcggcccagcccgggggauauuacaacggcacccgcgaggacagaaauaagcuccggcaucugaucagcgucaagcugggcaaaauuccuacaguggagaacucuaucuuccacauggcugccugguccgggagcgcuugccaugauggacgcgaauggaccuauauuggcguugacgggcccgauucuaaugcccuccugaagaucaaauacggagaggcguacacggacacauaucacuccuacgccaagaacauucuuagaacccaggaaagcgcuuguaauugcaucggcggggauuguuaucugaugauuacagacggaccggccuccggcaucucugagugccgguuucucaaaauccgcgagggcagaauuaucaaggaaauuuucccuaccgggcgggugaagcacaccgaggaauguacaugcggauuugcuagcaacaaaacgaucgagugugccugccgcgauaauuccuacaccgccaagagacccuucgucaaacugaacguggaaacagacaccgcugagauucggcuuaugugcacaaagaccuaucuggauacgccucgccccaaugacggcagcaucacagggcccugugagucugauggagacgaaggcuccgggggaaucaaaggcggcuuuguucaucaaagaauggcgagcaagauugggcggugguacucuagaaccaugagcaaaaccaagcgcaugggaaugggccucuaugugaaguacgacggggauccuuggacagacuccgaggcccuggcucugucuggagucauggugagcauggaggaaccgggcugguacuccuucggguuugaaaucaaagauaagaaaugcgacgugcccuguauuggcaucgagaugguccacgauggaggcaagaccacauggcauagcgccgccacggcuauuuauugccucauggggucuggacagcugcuuugggacaccguuacaggcgugaacaugacccuguga

SEQ ID NO: 213443 - RNA, 1401 nt, Artificial Sequence
  derived and/or modified sequence opt5 from neuraminidase__InfluenzaB__AKU40618
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugagcauggaggaaccgggcugguacuccuucggguuugaaaucaaagauaacaagugcgacguccccuguauuggcaucgagaugguucacgauggaggcaaaacaaccuggcauagcgcugccacagccauuuauugccucauggggucuggacagcugcuuugggacacggugaccggcgugaauaugacacuguga

SEQ ID NO: 213444 - RNA, 1401 nt, Artificial Sequence
  derived and/or modified sequence opt5 from neuraminidase__InfluenzaB__AKU40640
augcugcccagcaccauccagacacucacgcuguuccuuaccuccggcggggugcugcucucucuguacgucagcgccucccuuucuuaucugcucuacagcgacauucugcugaaguuuuccagaacagagaucgcugccccuauuaugccgcucgauugcgcgaacgcuucuaauguucaagccgugaaccggagcgccaccaaaggaguggcucugcuucugcccgaaccugaguggacauauccccgccucuccuguccuggcagcaccuuccagaaggcccugcuuaucucuccccacagauuuggggaaacaaaaggaaauuccgcuccucugauuauccgggagccguucaucgccugcggccccaaggaauguaaacauuuugcgcucacccacuacgccgcucagccugggggauauuacaacggcacgcgcgaggacagaaauaagcugcggcaucugauuagcgucaagcucggcaaaauccccaccguggagaacucuauuuuccacauggccgcuugguccgggagcgccugccaugauggacgcgaauggacauauaucggcguugacgggccugauaauaacgcgcugcuuaagauuaaauacggagaggccuacaccgacacauaucacucuuacgcuaagaauauccugagaacccaggaauccgccuguaacugcauuggcggggauuguuaucucaugaucacggacggacccgcuagcggcaucuccgagugccgguuucugaaaauucgcgagggcagaaucauuaaggaaaucuucccgacagggcgggugaagcacaccgaggaauguacaugcggauuugccucuaauaaaaccauugagugugccugccgcgauaacagcuacaccgcuaagagaccuuucgucaaacuuaauguggaaacagacacggcggagauccggcugaugugcaccgagacauaucucgauacaccccgcccuaacgacggcuccaucaccgggcccugugaaagcaauggagauaagggcucugggggaauuaaaggcggcuuuguucaucaaagaauggccuccaagaucgggcggugguacagcagaaccaugucuaaaacgaagcgcaugggaaugggccuguaugugaaguacgacggggaccccuggacagauagcgaggcucuggcccucuccggagucauggugucuauggaggaaccuggcugguacagcuucggguuugaaauuaaagacaagaaaugcgaugugccguguaucggcauugagaugguccacgacggaggcaagaccaccuggcauuccgccgcuacagccaucuauugccugauggggagcggacagcuucugugggauaccguuacaggcgugaacaugacgcucuga

SEQ ID NO: 213445 - RNA, 1401 nt, Artificial Sequence; identical to SEQ ID NO: 213398
  derived and/or modified sequence opt5 from neuraminidase__InfluenzaB__AKU40662

SEQ ID NO: 213446 - RNA, 1401 nt, Artificial Sequence
  derived and/or modified sequence opt5 from neuraminidase__InfluenzaB__AKU40673
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaauccgaguggaccuauccccgccugagcuguccuggcucuaccuuccagaaggcccuccugauuagcccccacagauuuggggaaacgaaaggaaauuccgcuccucuuaucauucgggagccguucaucgccugcggccccaaggaauguaaacauuuugcucugacccacuacgccgcgcagccugggggauauuacaacggcacacgcgaggacagaaauaagcuccggcaucugaucucugugaagcugggcaaaauucccaccguugagaacuccaucuuccacauggccgcuuggagcgggucugccugccaugauggacgcgaauggacauauauuggcguggacgggccugauuccaaugcucuccugaagaucaaauacggagaggccuacaccgacacguaucacagcuacgcgaagaacauucuuagaacacaggaauccgccuguaauugcaucggcggggauuguuaucugaugauuaccgacggacccgcuucuggcaucagcgagugccgguuucucaaaauccgcgagggcagaauuaucaaggaaauuuucccgacagggcgggucaagcacaccgaggaauguaccugcggauuugccuccaacaaaacaaucgagugugcuugccgcgauaauagcuacacggccaagagaccuuucgugaaacugaacguugaaaccgacacagccgagauucggcuuaugugcaccaagacauaucuggauacgccccgcccuaaugacggcucuaucaccgggcccugugaguccgauggagacgaaggcagcgggggaaucaaaggcggcuuugugcaucaaagaauggcuucuaagauugggcggugguacagcagaacaauguccaaaaccaagcgcaugggaaugggccucuaugucaaguacgacggggaucccuggaccgacucugaggcgcuggcccugagcggagugaugguguccauggaggaaccuggcugguacagcuucggguuugaaaucaaagauaagaaaugcgacgucccguguauuggcaucgagaugguucacgauggaggcaagacaaccuggcauucugcugccacagccauuuauugccucaugggguccggacagcugcuuugggacacggugaccggcgugaacaugacacuguga

SEQ ID NO: 213447 - RNA, 1401 nt, Artificial Sequence; identical to SEQ ID NO: 213398
  derived and/or modified sequence opt5 from neuraminidase__InfluenzaB__AKU40684

SEQ ID NO: 213448 - RNA, 1401 nt, Artificial Sequence; identical to SEQ ID NO: 213398
  derived and/or modified sequence opt5 from neuraminidase__InfluenzaB__AKU40695

SEQ ID NO: 213449 - RNA, 1401 nt, Artificial Sequence; identical to SEQ ID NO: 213398
  derived and/or modified sequence opt5 from neuraminidase__InfluenzaB__AKU40706

SEQ ID NO: 213450 - RNA, 1401 nt, Artificial Sequence; identical to SEQ ID NO: 213398
  derived and/or modified sequence opt5 from neuraminidase__InfluenzaB__AKU40717

SEQ ID NO: 213451 - RNA, 1401 nt, Artificial Sequence
  derived and/or modified sequence opt5 from neuraminidase__InfluenzaB__AKU40728
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugcucaagccgugaaccggagcgccacaaaaggagugacaccccugcuuccugaacccgaguggaccuauccucgccuguccugucccggcagcaccuuccagaaggcucuccugauuucuccucacagauuuggggaaacgaaaggaaauuccgccccgcuuaucauucgggagcccuucaucgcuugcggcccuaaggaauguaaacauuuugcccugacccacuacgcggcccagcccgggggauauuacaacggcacacgcgaggacagaaauaagcuccggcaucugaucagcgucaagcugggcaaaauuccuaccguggagaacucuaucuuccacauggcugccugguccgggagcgcuugccaugauggacgcgaauggacauauauuggcguugacgggcccgauucuaaugcccuccugaagaucaaauacggagaggcguacaccgacacguaucacuccuacgccaagaacauucuuagaacacaggaaagcgcuuguaauugcaucggcggggauuguuaucugaugauuaccgacggaccggccuccggcaucucugagugccgguuucucaaaauccgcgagggcagaauuaucaaggaaauuuucccuacagggcgggugaagcacaccgaggaauguaccugcggauuugcuagcaacaaaacaaucgagugugccugccgcgauaauuccuacacggccaagagacccuucgucaaacugaacguggaaaccgacacagcugagauucggcuuaugugcaccaagacauaucuggauaccccucgccccaaugacggcagcaucacggggcccugugagucugauggagacgaaggcuccgggggaaucaaaggcggcuuuguucaucaaagaauggcgagcaagauugggcggugguacucuagaacaaugagcaaaaccaagcgcaugggaaugggccucuaugugaaguacgacggggauccuuggaccgacuccgaggcccuggcucugucuggagucauggugagcauggaggaaccgggcugguacuccuucggguuugaaaucaaagauaagaaaugcgacgugcccuguauuggcaucgagaugguccacgauggaggcaagacaaccuggcauagcgccgccacagcuauuuauugccucauggggucuggacagcugcuuugggacacgguuaccggcgugaacaugacacuguga

SEQ ID NO: 213452 - RNA, 1401 nt, Artificial Sequence
  derived and/or modified sequence opt5 from neuraminidase__InfluenzaB__AKU40739
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagagaccuacacggacacauaucacuccuacgccaagaacauucuuagaacccaggaaagcgcguguaauugcaucggcggggauuguuaucugaugauuacagacggaccggccuccggcaucucugagugccgguuucucaaaauccgcgagggcagaauuaucaaggaaauuuucccuaccgggcgggucaagcacaccgaggaauguacaugcggauuugcuagcaacaaaacgaucgagugugccugccgcgauaauuccuacaccgcuaagagacccuucgugaaacugaacguugaaacagacaccgccgagauucggcuuaugugcacaaagaccuaucuggauacgccucgccccaaugacggcagcaucacagggcccugugagucugauggagacgaaggcuccgggggaaucaaaggcggcuuugugcaucaaagaauggccagcaagauugggcggugguacucuagaaccaugagcaaaaccaagcgcaugggaaugggccucuaugucaaguacgacggggauccuuggacagacuccgaggcucuggcgcugucuggagugauggugagcauggaggaaccgggcugguacuccuucggguuugaaaucaaagauaagaaaugcgacguccccuguauuggcaucgagaugguucacgauggaggcaagaccacauggcauagcgccgcuacggccauuuauugccucauggggucuggacagcugcuuugggacaccgugacaggcgugaacaugacccuguga

SEQ ID NO: 213453 - RNA, 1401 nt, Artificial Sequence
  derived and/or modified sequence opt5 from neuraminidase__InfluenzaB__AKU40750
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucauuccccugcuuccugaacccgaguggaccuauccucgccuguccugucccggcagcacauuccagaaggcccuccugaucucuccucacagauuuggggaaaccaaaggaaauuccgcuccgcuuauuauccgggagcccuucaucgccugcggcccuaaggaauguaaacauuuugcucugacgcacuacgccgcgcagcccgggggauauuacaacggcacccgcgaggacagaaauaagcuccggcaucugauuagcgugaagcugggcaaaaucccuacaguugagaacucuauuuuccacauggccgcuugguccgggagcgccugccaugauggacgcgaauggaccuauaucggcguggacgggcccgauucuaaugcucuccugaagauuaaauacggagaggccuacacagacaccuaucacuccuacgcgaagaacauccuuagaacgcaggaaagcgccuguaauugcauuggcggggauuguuaucugaugaucacagacggaccggcuuccggcaucucugagugccgguuucucaaaauucgcgagggcagaaucauuaaggaaaucuucccuaccgggcgggucaagcacacagaggaauguaccugcggauuugccagcaacaaaaccauugagugugcuugccgcgauaauuccuacacagccaagagacccuucgugaaacugaacguugaaacggacaccgccgagauccggcuuaugugcacaaagaccuaucuggauacaccucgccccaaugacggcagcaucaccgggcccugugagucugauggagacgaaggcuccgggggaauuaaaggcggcuuugugcaucaaagaauggcuagcaagaucgggcggugguacucuagaacgaugagcaaaacaaagcgcaugggaaugggccucuaugucaaguacgacggggauccuuggaccgacuccgaggcgcuggcccugucuggagugauggugagcauggaggaaccgggcugguacuccuucggguuugaaauuaaagauaagaaaugcgacguccccuguaucggcauugagaugguucacgauggaggcaagaccacauggcauagcgcugccaccgccaucuauugccucauggggucuggacagcugcuuugggacacagugacgggcgugaacaugacccuguga

SEQ ID NO: 213454 - RNA, 1401 nt, Artificial Sequence; identical to SEQ ID NO: 213398
  derived and/or modified sequence opt5 from neuraminidase__InfluenzaB__AKU40761

SEQ ID NO: 213455 - RNA, 1401 nt, Artificial Sequence; identical to SEQ ID NO: 213398
  derived and/or modified sequence opt5 from neuraminidase__InfluenzaB__AKU40772

SEQ ID NO: 213456 - RNA, 1401 nt, Artificial Sequence; identical to SEQ ID NO: 213398
  derived and/or modified sequence opt5 from neuraminidase__InfluenzaB__AKU40783

SEQ ID NO: 213457 - RNA, 1401 nt, Artificial Sequence
  derived and/or modified sequence opt5 from neuraminidase__InfluenzaB__AKU40794
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacacaucuaaugugcaagcggugaaccggagcgcuaccaaaggagucacaccccugcuuccugaacccgaguggaccuauccucgccuguccugucccggcagcacguuccagaaggcccuccugauuucuccucacagauuuggggaaaccaaaggaaaguccgccccgcuuaucauucgggagcccuucaucgcuugcggcccuaaagaauguaagcauuuugcccugacacacuacgcugcccagcccgggggauauuacaauggcacccgcgaggacagaaacaagcuccggcaucugaucagcgugaaacugggcaagauuccuacaguugaaaauucuaucuuccacauggcggccugguccgggagcgcuugccaugauggacgcgaauggaccuauauuggcguggacgggcccgauucuaacgcccuccugaaaaucaaguacggagaggcuuacacggacacauaucacuccuacgccaaaaauauucuuagaacccaggaaagcgcguguaacugcaucggcggggauuguuaucugaugauuacagacggaccggccuccggcaucucugagugccgguuucucaagauccgcgagggcagaauuaucaaggaaauuuucccuaccgggcgggucaaacacaccgaggaauguacaugcggauuugcuagcaauaagacgaucgagugugccugccgcgauaacuccuacaccgcuaaaagacccuucgugaagcugaauguugaaacagacaccgccgagauucggcuuaugugcacaaaaaccuaucuggauacgccucgccccaacgacggcagcaucacagggcccugugagucugauggagacgaaggcuccgggggaaucaagggcggcuuugugcaucaaagaauggccagcaaaauugggcggugguacucuagaaccaugagcaagaccaagcgcaugggaaugggccucuaugucaaauacgacggggauccuuggacagacuccgaggcucuggcgcugucuggagugauggugagcauggaggagccgggcugguacuccuucggguuugaaaucaaggauaaaaagugcgacguccccuguauuggcaucgagaugguucacgauggaggcaaaaccacauggcauagcgccgcuacggccauuuauugccucauggggucuggacagcugcuuugggacaccgugacaggcgugaauaugacccuguga

SEQ ID NO: 213458 - RNA, 1401 nt, Artificial Sequence; identical to SEQ ID NO: 213398
  derived and/or modified sequence opt5 from neuraminidase__InfluenzaB__AKU40805

SEQ ID NO: 213459 - RNA, 1401 nt, Artificial Sequence; identical to SEQ ID NO: 213398
  derived and/or modified sequence opt5 from neuraminidase__InfluenzaB__AKU40816

SEQ ID NO: 213460 - RNA, 1401 nt, Artificial Sequence; identical to SEQ ID NO: 213398
  derived and/or modified sequence opt5 from neuraminidase__InfluenzaB__AKU40827

SEQ ID NO: 213461 - RNA, 1401 nt, Artificial Sequence; identical to SEQ ID NO: 213398
  derived and/or modified sequence opt5 from neuraminidase__InfluenzaB__AKU40838

SEQ ID NO: 213462 - RNA, 1401 nt, Artificial Sequence; identical to SEQ ID NO: 213398
  derived and/or modified sequence opt5 from neuraminidase__InfluenzaB__AKU40849

SEQ ID NO: 213463 - RNA, 1401 nt, Artificial Sequence; identical to SEQ ID NO: 213398
  derived and/or modified sequence opt5 from neuraminidase__InfluenzaB__AKU40860

SEQ ID NO: 213464 - RNA, 1401 nt, Artificial Sequence
  derived and/or modified sequence opt5 from neuraminidase__InfluenzaB__AKU40871
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucgcuccccugcuuccugaacccgaguggaccuauccucgccuguccugucccggcagcacauuccagaaggcccuccugauuucuccucacagauuuggggaaaccaaaggaaauuccgccccgcuuaucauucgggagcccuucaucgcuugcggcccuaaggaauguaaacauuuugcccugacgcacuacgcggcccagcccgggggauauuacaacggcacccgcgaggacagaaauaagcuccggcaucugaucagcgugaagcugggcaaaauuccuacaguugagaacucuaucuuccacauggcugccugguccgggagcgcuugccaugauggacgcgaauggaccuauauuggcguggacgggcccgauucuaaugcccuccugaagaucaaauacggagaggcguacacagacaccuaucacuccuacgccaagaacauucuuagaacgcaggaaagcgcuuguaauugcaucggcggggauuguuaucugaugauuacagacggaccggccuccggcaucucugagugccgguuucucaaaauccgcgagggcagaauuaucaaggaaauuuucccuaccgggcgggucaagcacacagaggaauguaccugcggauuugcuagcaacaaaaccaucgagugugccugccgcgauaauuccuacacagccaagagacccuucgugaaacugaacguugaaacggacaccgcugagauucggcuuaugugcacaaagaccuaucuggauacaccucgccccaaugacggcagcaucaccgggcccugugagucugauggagacgaaggcuccgggggaaucaaaggcggcuuugugcaucaaagaauggcgagcaagauugggcggugguacucuagaacgaugagcaaaacaaagcgcaugggaaugggccucuaugucaaguacgacggggauccuuggaccgacuccgaggcccugacccugucuggagugauggugagcauggaggaaccgggcugguacuccuucggguuugaaaucaaagauaagaaaugcgacguccccuguauuggcaucgagaugguucacgauggaggcaagacaaccuggcauagcgcugccacagccauuuauugccucauggggucuggacagcugcuuugggacacggugaccggcgugaacaugacacuguga

SEQ ID NO: 213465 - RNA, 1401 nt, Artificial Sequence; identical to SEQ ID NO: 213398
  derived and/or modified sequence opt5 from neuraminidase__InfluenzaB__AKU40882

SEQ ID NO: 213466 - RNA, 1401 nt, Artificial Sequence
  derived and/or modified sequence opt5 from neuraminidase__InfluenzaB__AKU40893
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgucaagcucgggaagauuccuacaguggaaaauucuaucuuccacauggccgcuugguccggaagcgccugccaugauggcaaagaguggaccuauauugggguugacggacccgauaacaaugcucugcuuaaggugaaauacggcgaggccuacacggacacauaucacucuuacgcgaacaagauccugcggacccaggaguccgccuguaauugcauugggggaaacuguuaucucaugaucacagauggcagcgcuuccggcgucucugaaugccgcuuucugaaaauuagagaggggcggaucaucaaggagauuuucccgaccggacgcgugaagcacaccgaagaguguacaugcggcuuugccagcaauaaaacgaucgaaugugcuugcagagacaaccgguacaccgccaagcgcccuuucguuaaacuuaauguggagacagauaccgccgaaauuagacugaugugcacagacaccuaucucgauacgccccggccuaacgacggguccaucacaggacccugugagagcgauggcgacaaggggucuggaggcauuaaaggcggguuuguccaucaacgcaugaaguccaaaaucggaagaugguacagccggaccaugucuaagaccgagagaaugggcauggggcuguaugugaaguacgacggagaucccugggcugacagcggcgcgcuggccuucuccggggugauggucucuaugaaagaaccuggcugguacagcuuuggauucgagaucaaggauaaaaagugcgacguuccguguauuggcaucgaaauggugcacgaugggggaaaagagacauggcauuccgcugccaccgccauuuauugccucaugggcagcgggcagcugcuuugggacacagugacgggagucgauauggcucuguga

SEQ ID NO: 213467 - RNA, 1401 nt, Artificial Sequence; identical to SEQ ID NO: 213398
  derived and/or modified sequence opt5 from neuraminidase__InfluenzaB__AKU40904

SEQ ID NO: 213468 - RNA, 1401 nt, Artificial Sequence
  derived and/or modified sequence opt5 from neuraminidase__InfluenzaB__AKU40915
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugccgauggaggaacccggcugguacagcuucggguuugaaaucaaagauaagaaaugcgacgucccuuguauuggcaucgagaugguucacgauggaggcaagacaaccuggcauuccgcugccacagccauuuauugccucauggggagcggacagcugcuuugggacacggugaccggcgugaacaugacacuguga

SEQ ID NO: 213469 - RNA, 1401 nt, Artificial Sequence; identical to SEQ ID NO: 213398
  derived and/or modified sequence opt5 from neuraminidase__InfluenzaB__AKU40926

SEQ ID NO: 213470 - RNA, 1401 nt, Artificial Sequence; identical to SEQ ID NO: 213452
  derived and/or modified sequence opt5 from neuraminidase__InfluenzaB__AKU40937

SEQ ID NO: 213471 - RNA, 1401 nt, Artificial Sequence; identical to SEQ ID NO: 213398
  derived and/or modified sequence opt5 from neuraminidase__InfluenzaB__AKU40948

SEQ ID NO: 213472 - RNA, 1401 nt, Artificial Sequence; identical to SEQ ID NO: 213398
  derived and/or modified sequence opt5 from neuraminidase__InfluenzaB__AKU40959

SEQ ID NO: 213473 - RNA, 1401 nt, Artificial Sequence; identical to SEQ ID NO: 213398
  derived and/or modified sequence opt5 from neuraminidase__InfluenzaB__AKU40970

SEQ ID NO: 213474 - RNA, 1401 nt, Artificial Sequence; identical to SEQ ID NO: 213398
  derived and/or modified sequence opt5 from neuraminidase__InfluenzaB__AKU40981

SEQ ID NO: 213475 - RNA, 1401 nt, Artificial Sequence; identical to SEQ ID NO: 213398
  derived and/or modified sequence opt5 from neuraminidase__InfluenzaB__AKU40991

SEQ ID NO: 213476 - RNA, 1401 nt, Artificial Sequence; identical to SEQ ID NO: 213398
  derived and/or modified sequence opt5 from neuraminidase__InfluenzaB__AKU41002

SEQ ID NO: 213477 - RNA, 1401 nt, Artificial Sequence; identical to SEQ ID NO: 213398
  derived and/or modified sequence opt5 from neuraminidase__InfluenzaB__AKU41013

SEQ ID NO: 213478 - RNA, 1401 nt, Artificial Sequence; identical to SEQ ID NO: 213398
  derived and/or modified sequence opt5 from neuraminidase__InfluenzaB__AKU41024

SEQ ID NO: 213479 - RNA, 1401 nt, Artificial Sequence; identical to SEQ ID NO: 211985
  derived and/or modified sequence opt5 from neuraminidase__InfluenzaB__EPI173278

SEQ ID NO: 213480 - RNA, 1401 nt, Artificial Sequence; identical to SEQ ID NO: 211985
  derived and/or modified sequence opt5 from neuraminidase__InfluenzaB__EPI498049

SEQ ID NO: 213481 - RNA, 1401 nt, Artificial Sequence; identical to SEQ ID NO: 211985
  derived and/or modified sequence opt5 from neuraminidase__InfluenzaB__AFH57913

SEQ ID NO: 213482 - RNA, 1401 nt, Artificial Sequence; identical to SEQ ID NO: 211985
  derived and/or modified sequence opt5 from neuraminidase__InfluenzaB__EPI827074

SEQ ID NO: 213483 - RNA, 1401 nt, Artificial Sequence; identical to SEQ ID NO: 211985
  derived and/or modified sequence opt5 from neuraminidase__InfluenzaB__EPI244698

SEQ ID NO: 213484 - RNA, 1401 nt, Artificial Sequence; identical to SEQ ID NO: 211985
  derived and/or modified sequence opt5 from neuraminidase__InfluenzaB__EPI244701

SEQ ID NO: 213485 - RNA, 1401 nt, Artificial Sequence; identical to SEQ ID NO: 213398
  derived and/or modified sequence opt5 from neuraminidase__InfluenzaB__EPI540672

SEQ ID NO: 213486 - RNA, 1401 nt, Artificial Sequence; identical to SEQ ID NO: 213398
  derived and/or modified sequence opt5 from neuraminidase__InfluenzaB__EPI829465

SEQ ID NO: 213487 - RNA, 1401 nt, Artificial Sequence
  derived and/or modified sequence opt5 from neuraminidase__InfluenzaB__EPI684428
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuacaaugccgcucgauugcgccaacgcgucuaaugugcaagcugugaaccggagcaccacaaaaggagucacgccccuguucccugaacccgaguggaccuauccucgccuuuccugucccggcagcaccuuucagaaggcccugcucaucucuccucacagauucggggaaacaaaaggaaauuccgccccgcugauuauccgggagcccuuuauugcuugcggcccuaaggaauguaaacauuucgcccuuacccacuacgcugcccagcccgggggauauuacaacggcacacgcgaggacagaaauaagcugcggcaucucaucagcgugaagcugggcaaaaucccuaccguugagaacucuauuuuucacauggcggccugguccgggagcgcuugccaugauggacgcgaauggacguauaucggcguggacgggcccgauucuaaugcccugcucaagauuaaauacggagaggcuuacacagacaccuaucacuccuacgccaagaacauccugagaacacaggaaagcgcguguaauugcauuggcggggauuguuaucuuaugaucaccgacggaccggccuccggcgucucugagugccgguuccugaaaauucgcgagggcagaaucaucaaggaaauuuuuccuaccgggcgggugaagcacacagaggaauguacgugcggauucgcuagcaacaaaaccaucgagugugccugccgcgauaauagauacacagcuaagcggcccuuuguuaaacucaacguggaaaccgacacagccgagauucgccugaugugcaccaagacguaucuugauacaccuagacccaaugacggcuccaucaccgggcccugugagagcgauggagacgaaggcucugggggaauuaaaggcggcuucguccaucaacggauggccuccaagaucgggagaugguacagccgcaccaugucuaaaacaaagcggaugggaaugggccuguaugugaaguacgacggggauccuuggaccgacagcgaggcucucgcgcuguccggagugauggucucuauggaggaaccgggcugguacagcuuuggguucgaaaucaaagauaagaaaugcgacguucccuguauuggcaucgagauggugcacgauggaggcaagacaacguggcauuccgccgcuaccgccauuuauugccugauggggagcggacagcuccugugggacacagugaccggcgucaacaugacacuuuga

SEQ ID NO: 213488 - RNA, 1401 nt, Artificial Sequence; identical to SEQ ID NO: 212007
  derived and/or modified sequence opt5 from neuraminidase__InfluenzaB__AFH58451

SEQ ID NO: 213489 - RNA, 1401 nt, Artificial Sequence; identical to SEQ ID NO: 211985
  derived and/or modified sequence opt5 from neuraminidase__InfluenzaB__EPI173280

SEQ ID NO: 213490 - RNA, 1401 nt, Artificial Sequence; identical to SEQ ID NO: 211985
  derived and/or modified sequence opt5 from neuraminidase__InfluenzaB__EPI186302

SEQ ID NO: 213491 - RNA, 1401 nt, Artificial Sequence
  derived and/or modified sequence opt5 from neuraminidase__InfluenzaB__EPI636339
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucgucgccugcggcccuaacgaauguaagcauuuugcucucacacacuacgccgcgcagcccgggggauauuacaauggcacccggggcgaccgcaacaaacugagacaucugaucagcgugaagcucgggaagaucccuacaguugaaaauucuauuuuccacauggccgcuugguccggaagcgccugccaugauggcaaagaguggaccuauaucgggguggacggacccgauaacaaugcucugcuuaaggucaaauacggcgaggccuacacggacacauaucacucuuacgcgaacaauauucugcggacccaggaguccgccuguaacugcaucgggggaaauuguuaucucaugauuacagauggcagcgcuuccggcgugucugaaugccgcuuucugaagaucagagaggggcggauuaucaaagagaucuucccgaccggacgcguuaagcacaccgaagaguguacaugcggcuuugccagcaacaagacgauugaaugugcuugcagagacaaucgguacaccgccaaacgcccuuucgugaaacuuaacgucgagacagauaccgccgaaaucagacugaugugcacagacaccuaucucgauacgccccggccuaacgacggguccauuacaggacccugugagagcgauggcgacaaggggucuggaggcaucaagggcggguuugugcaucaacgcaugaaauccaagauuggaagaugguacagccggaccaugucuaaaaccgagagaaugggcauggggcuguaugugaaguacggaggcgaccccugggcugauagcgacgcgcuggccuucuccggggucaugguuucuaugaaggaaccuggcugguacagcuuuggauucgagaucaaagauaagaaaugcgacgugccguguaucggcauugaaauggugcacgaugggggaaaggagacauggcauuccgcugccaccgccaucuauugccucaugggcagcgggcagcugcuuugggacacagucacgggaguggauauggcucuguga

SEQ ID NO: 213492 - RNA, 1401 nt, Artificial Sequence; identical to SEQ ID NO: 213491
  derived and/or modified sequence opt5 from neuraminidase__InfluenzaB__EPI645996

SEQ ID NO: 213493 - RNA, 1401 nt, Artificial Sequence
  derived and/or modified sequence opt5 from neuraminidase__InfluenzaB__EPI539770
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugcucaagccgugaaccggagcgccacaaaaggagugacaccccugcuuccugaacccgaguggaccuauccucgccuguccugucccggcagcaccuuccagaaggcucuccugauuucuccucacagauuuggggaaacgaaaggaaauuccgccccgcuuaucauucgggagcccuucaucgcuugcggcccuaaggaauguaaacauuuugcccugacccacuacgcggcccagcccgggggauauuacaacggcacacgcgaggacagaaauaagcuccggcaucugaucagcgucaagcugggcaaaauuccuaccguggagaacucuaucuuccacauggcugccugguccgggagcgcuugccaugauggacgcgaauggacauauauuggcguugacgggcccgauucuaaugcccuccugaagaucaaauacggagaggcguacaccgacacguaucacuccuacgccaagaacauucuuagaacacaggaaagcgcuuguaauugcaucggcggggauuguuaucugaugauuaccgacggaccggccuccggcaucucugagugccgguuucucaaaauccgcgagggcagaauuaucaaggaaauuuucccuacagggcgggugaagcacaccgaggaauguaccugcggauuugcuagcaacaaaacaaucgagugugccugccgcgauaauuccuacacggccaagagacccuucgucaaacugaacguggaaaccgacacagcugagauucggcuuaugugcaccaagacauaucuggauaccccucgccccaaugacggcagcaucacggggcccugugagucugauggagacgaaggcuccgggggaaucaaaggcggcuuuguucaucaaagaauggcgagcaagauugggcggugguacucuagaacaaugagcaaaaccaagcgcaugggaaugggccucuaugugaaguacgacggggauccuuggaccgacuccgaggcccuggcucugucuggagucauggugagcauggaggaaccgggcugguacuccuucggguuugaaaucaaagauaagaaaugcgacgugcccuguauuggcaucgagaugguccacgauggaggcaagacaaccuggcauagcgccgccacaacgauuuauugccucauggggucuggacagcugcuuugggacaccguuacaggcgugaacaucacccuguga

SEQ ID NO: 213494 - RNA, 1401 nt, Artificial Sequence; identical to SEQ ID NO: 213493
  derived and/or modified sequence opt5 from neuraminidase__InfluenzaB__EPI551248

SEQ ID NO: 213495 - RNA, 1401 nt, Artificial Sequence; identical to SEQ ID NO: 213493
  derived and/or modified sequence opt5 from neuraminidase__InfluenzaB__EPI544258

SEQ ID NO: 213496 - RNA, 1401 nt, Artificial Sequence; identical to SEQ ID NO: 213398
  derived and/or modified sequence opt5 from neuraminidase__InfluenzaB__EPI592698

SEQ ID NO: 213497 - RNA, 1401 nt, Artificial Sequence; identical to SEQ ID NO: 213398
  derived and/or modified sequence opt5 from neuraminidase__InfluenzaB__EPI592706

SEQ ID NO: 213498 - RNA, 1401 nt, Artificial Sequence
  derived and/or modified sequence opt5 from neuraminidase__InfluenzaB__EPI693093
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggagagcaagauugggcggugguacucuagaacaaugagcaaaaccaagcgcaugggaaugggccucuaugucaaguacgacggggauccuuggaccgacuccgaagcucuggcgcugucuggagugauggugagcauggaggaaccgggcugguacuccuucggguuugagaucaaagauaagaaaugcgacguccccuguauuggcaucgagaugguucacgauggaggcaagacaaccuggcauagcgccgcuacagccauuuauugccucauggggucuggacagcugcuuugggacacggugaccggcgugaacaugacacuguga

SEQ ID NO: 213499 - RNA, 1401 nt, Artificial Sequence
  derived and/or modified sequence opt5 from neuraminidase__InfluenzaB__EPI678795
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggagugacauuccugcuuccugaacccgaguggaccuauccucggcuguccugucccggcagcacguuucagaaggcccuccugauuucuccucaccgcuucggggaaaccaaaggaaauuccgcuccgcuuaucauuagagagcccuuugucgccugcggcccuaacgaauguaagcauuucgcucugacacacuacgccgcgcagcccgggggauauuacaauggcacccggggcgaccgcaacaaacucagacaucugaucagcgugaagcuggggaagaucccuacaguugaaaauucuauuuuucacauggccgcuugguccggaagcgccugccaugauggcaaagaguggaccuauaucgggguggacggacccgauaacaaugcucuccugaaggucaaauacggcgaggccuacacggacacauaucacucuuacgcgaacaauauucuucggacccaggaguccgccuguaacugcaucgggggaaauuguuaucugaugauuacagauggcagcgcuuccggcgugucugaaugccgcuuccucaagaucagagaggggcggauuaucaaagagaucuuuccgaccggacgcguuaagcacaccgaagaguguacaugcggcuucgccagcaacaagacgauugaaugugcuugcagagacaaucgguacaccgccaaacgcccuuuugugaagcugaacgucgagacagauaccgccgaaaucagacuuaugugcacagacaccuaucuggauacgccccggccuaacgacggguccauuacaggacccugugagagcgauggcgacaaagggucuggaggcaucaagggcggguucgugcaucaacgcaugaaauccaagauuggaagaugguacagccggaccaugucuaaaaccgagagaaugggcauggggcucuaugugaaguacggaggcaaucccugggcugacagcgaugcgcugacauuuuccggggucaugguuucuaugaaggaaccuggcugguacagcuucggauucgagaucaaagacaagaaaugcgaugugccguguaucggcauugaaauggugcacgacgggggaaaggagaccuggcauuccgccgcuacagccaucuauugccugaugggcagcgggcagcuccugugggauacggucaccggaguggacauggcccuuuga

SEQ ID NO: 213500 - RNA, 1401 nt, Artificial Sequence; identical to SEQ ID NO: 213499
  derived and/or modified sequence opt5 from neuraminidase__InfluenzaB__EPI721063

SEQ ID NO: 213501 - RNA, 1401 nt, Artificial Sequence; identical to SEQ ID NO: 211919
  derived and/or modified sequence opt5 from neuraminidase__InfluenzaB__EPI328903

SEQ ID NO: 213502 - RNA, 1401 nt, Artificial Sequence
  derived and/or modified sequence opt5 from neuraminidase__InfluenzaB__EPI543192
augcugcccagcaccauccagacacucacgcuguuccuuaccuccggcggggugcugcucucucuguacgucagcgccucccuuucuuaucugcucuaccuggacauucugcucaaguuuccuagcacagagaucaccgcuccgacaaugccccuggauugcgccaacgcguccaauguucaagcugugaacagaucugccaccaaaggagugacacuucugcucccugaacccgaguggaccuauccucggcugagcugucccggcuccacguuccagaaggcccuucugauuagcccucaccgcuuuggggaaaccaaaggaaauucugcuccgcucaucauuagagagcccuucaucgccugcggcccuaaggaauguaaacauuuugcucugacacacuacgccgcgcagcccgggggauauuacaacggcacccggggcgaccgcaauaagcugagacaucucaucuccgucaagcuggggaaaauuccuacaguggagaacagcaucuuccacauggccgcuuggucuggauccgccugccaugauggcaaggaguggaccuauauugggguugacggacccgauaauaacgcucugcuuaaaaucaaguacggcgaagccuacacggacacauaucacagcuacgcgaauaacauucuccggacccaggagucugccuguaauugcaucgggggaaacuguuaucugaugauuacagauggcuccgcuagcggcguguccgaaugccgcuuucuuaaaaucagagaggggcggaucaugaaggagauuuucccgaccggacgcacccaacacacagaagaguguacgugcggcuuugccucuaauaagaccaucgaaugugcuugcagagacaacagcuacacagccaaacggccuuucgucaagcugaauguggagaccgauacagccgaaauucgccucaugugcaccaaaacguaucuggacacacccagaccugaugacggguccaucaccggacccugugagagcaacggcgggaagggaucuggcggcauuaaagggggauuuguucaucagcggauggcuuccaagaucggccgcugguacagcagaaccaugucuaaaacagagcggaaggggaugggacuguauaucaaguacaacggcgaucccugggcggacagcgacgcccucaccuucuccggggugauggucucuauggaggaaccuggcugguacagcuuuggauucgaaauuaaagauaagaaaugcgacgugccguguaucggcauugagauggugcacgaugggggaaaggaaacauggcauuccgcugccacggccaucuauugccugaugggcagcgggcagcuucugugggacaccgucacaggaguuaauaugacccucuga

SEQ ID NO: 213503 - RNA, 1401 nt, Artificial Sequence; identical to SEQ ID NO: 213502
  derived and/or modified sequence opt5 from neuraminidase__InfluenzaB__EPI500360

SEQ ID NO: 213504 - RNA, 1401 nt, Artificial Sequence
  derived and/or modified sequence opt5 from neuraminidase__InfluenzaB__EPI543186
augcugcccagcaccauccagacacucacgcuguuccuuaccuccggcggggugcugcucucucuguacgucagcgccucccuuucuuaucugcucuacagcgacauucugcugaaguuuuccagaacagagguuaccgcuccuaucaugccgcucgauugcgccaacgcgucuaaugugcaagcugugaaccggagcgccacaaaaggagucacaccccugcuuccugaacccgaguggaccuauccucgccuguccugucccggcagcaccuuccagaaggcccuccugauuucuccucacagauuuggggaaacgaaaggaaauuccgcuccgcuuaucauucgggagcccuucaucgccugcggcccuaaggaauguaaacauuuugcucugacccacuacgccgcgcagcccgggggauauuacaacggcacacgcgaggacagaaauaagcuccggcaucugaucagcgugaagcugggcaaaauuccuaccguugagaacucuaucuuccacauggccgcuugguccgggagcgccugccaugauggacgcgaauggacauauauuggcguggacgggcccgauucuaaugcucuccugaagaucaaauacggagaggccuacaccgacacguaucacuccuacgcgaagaacauucuuagaacacaggaaagcgccuguaauugcaucggcggggauuguuaucugaugauuaccgacggaccggcuuccggcaucucugagugccgguuucucaaaauccgcgagggcagaauuaucaaggaaauuuucccuacagggcgggucaagcacaccgaggaauguaccugcggauuugccagcaacaaaacaaucgagugugcuugccgcgauaauuccuacacggccaagagacccuucgugaaacugaacguugaaaccgacacagccgagauucggcuuaugugcaccaagacauaucuggauaccccucgccccaaugacggcagcaucacggggcccugugagucugauggagacgaaggcuccgggggaaucaaaggcggcuuugugcaucaaagaauggcuagcaagauugggcggugguacucuagaacaaugagcaaaaccaagcgcaugggaaugggccucuaugucaaguacgacggggauccuuggaccgacuccgaggcgcuggcccugucuggagugauggugagcauggaggaaccgggcugguacuccuucggguuugaaaucaaagauaagaaaugcgacguccccuguauuggcaucgagaugguucacgauggaggcaagacaaccuggcauagcgcugccacagugauuuauugccucauggggucuggacagcugcuuugggacacggugaccggcgucaacaugacacuguga

SEQ ID NO: 213505 - RNA, 1401 nt, Artificial Sequence; identical to SEQ ID NO: 213504
  derived and/or modified sequence opt5 from neuraminidase__InfluenzaB__EPI536448

SEQ ID NO: 213506 - RNA, 1401 nt, Artificial Sequence
  derived and/or modified sequence opt5 from neuraminidase__InfluenzaB__NP_056663
augcugcccagcaccgugcagacacucacgcugcuucugaccuccggcgggguccuccugucucuuuacguuagcgccucccugucuuaucuccuguacagcgacgugcugcucaaguucuccucuacaaaaaccacagcuccuaccaugagccuggagugcacaaacgccuccaaugcgcaaaccgugaaccacagcgcuacgaaggaaaugaccuuuccgcccccugagcccgaauggacauauccuagacuuucuugucagggauccaccuuccagaaagcccugcucaucagcccccaucgguuuggcgagauuaagggaaauucugccccucugaucauucgcgaaccguucgucgcuugcgggcccaaagaguguagacacuuugcccuuacacauuacgcugcccagccuggcggguauuacaacggaacccggaaggaucgcaauaagcugagacaccucguguccguuaaacugggcaagauccccacgguggagaacagcauuuuccauauggcggccuggucuggcuccgcuugccacgacgggcgggaauggacauauaucggagucgauggcccugacaaugaugcccuggugaaaaucaaguacggggaggcuuacaccgacacauaucacagcuacgcccauaacauucuccgcacccaagaauccgcguguaauugcaucggaggcgauuguuaucugaugauuaccgacgggucugccagcggaaucuccaaaugcagauuucuuaagauucgggagggccgcaucauuaaggagauccugcccacaggcagaguugaacacacggaggaauguaccugcggguucgcuagcaacaaaacaaucgagugugccugccgggauaauucuuacaccgcuaagcgcccguuugugaaacucaacgucgaaacagacaccgccgagauuagacugaugugcacgaagacauaucuugauaccccucggcccgacgauggauccaucgccggcccuugugagagcaauggggacaaauggcugggaggcauuaaagggggauucgugcaucagcgcauggcuucuaagaucggcagaugguacagccggaccauguccaagacaaacagaaugggcauggaacucuaugugaaguacgacggggaucccuggaccgacucugaugcgcugacacugagcggagucaugguuuccauugaggaacccggcugguacagcuuuggguucgagaucaaagacaagaaaugcgaugugccuuguaucggaauugaaauggugcacgacggcgggaaggauacguggcacucugccgcuaccgccaucuauugccucaugggcuccggacagcugcuuugggacacagucaccggcguggauauggcccuguga

SEQ ID NO: 213507 - RNA, 1401 nt, Artificial Sequence
  derived and/or modified sequence opt5 from neuraminidase__InfluenzaB__ABG85180
augcugcccagcaccgugcagacacucacgcugcuucugaccuccggcgggguccuccugucucuuuacguuagcgccucccugucuuaucuccuguacagcgacgugcugcucaaguucuccucuacaaaaaccacagcuccuaccaugagccuggagugcacaaacgccuccaaugcgcaaaccgugaacuauagcgcuacgaaggaaaugaccuuuccgcccccugagcccgaauggacauacccuagacuuucuugucagggauccaccuuccagaaagcccugcucaucagcccccaccgguuuggcgagauuaagggaaauucugccccucugaucauucgcgaaccguucgucgcuugcgggcccaaagaguguagacauuuugcccuuacacacuaugcugcccagccuggcggguacuaucauggaacccggaaggaucgcaacaagcugagacaccucguguccguuaaacugggcaagauccccacgguggagaauagcauuuuccauauggcggccuggucuggcuccgcuugccacgacgggcgggaauggacauacaucggagucgauggcccugacaacgaugcccuggugaaaaucaaguacggggaggcuuauaccgacacauaccacagcuaugcccauaauauucuccgcacccaagaauccgcguguaacugcaucggaggcgauuguuaccugaugauuaccgacgggucugccagcggaaucuccaaaugcagauuucuuaagauucgggagggccgcaucauuaaggagauccugcccacaggcagaguugaacacacggaggaauguaccugcggguucgcuagcaauaaaacaaucgagugugccugccgggauaacucuuauaccgcuaagcgcccguuugugaaacucaaugucgaaacagacaccgccgagauuagacugaugugcacgaagacauaccuugauaccccucggcccgacgauggauccaucgccggcccuugugagagcaacggggacaaaggacugggcgggauuaagggaggcuucgugcaucagcgcauggcuuuuaaaaucggcagaugguauucucggaccaugagcaagacaaauagaauggggauggaacucuacgugaaguacgacggagaucccuggaccgacuccgaugcgcugacacugucuggcgucaugguuagcauugaggaacccgggugguauuccuucggauuugagaucaaagacaagaaaugcgaugugccuuguaucggcauugaaauggugcacgacgggggcgaggauacguggcacagcgccgcuaccgccaucuacugccucaugggaucuggccagcugcuuugggacacagucaccgggauugauauggcccuguga

SEQ ID NO: 213508 - RNA, 1401 nt, Artificial Sequence; identical to SEQ ID NO: 213397
  derived and/or modified sequence opt5 from neuraminidase__InfluenzaB__EPI376345

SEQ ID NO: 213509 - RNA, 1401 nt, Artificial Sequence; identical to SEQ ID NO: 213397
  derived and/or modified sequence opt5 from neuraminidase__InfluenzaB__EPI368424

SEQ ID NO: 213510 - RNA, 1401 nt, Artificial Sequence
  derived and/or modified sequence opt5 from neuraminidase__InfluenzaB__EPI331150
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcuaugaacagaagcgccaccaaaggagugacacugcuucugccugaacccgaguggaccuauccucggcucuccugucccggcagcacguuccagaaggcccugcuuauuucuccucaccgcuuuggggaaaccaaaggaaauuccgcuccgcugaucauuagagagcccuucaucgccugcggcccuaacgaauguaagcauuuugcucucacacacuacgccgcgcagcccgggggauauuacaauggcacccggggcgaccgcaacaaacugagacaucugaucagcgugaagcucgggaagauuccuacagucgaaaauucuaucuuccacauggccgcuugguccggaagcgccugccaugauggcaaagaguggaccuauauugggguggacggacccgauaacaaugcucugcuuaagguuaaauacggcgaggccuacacggacacauaucacucuuacgcgaacaagauccugcggacccaggaguccgccuguaauugcauugggggaaacuguuaucucaugaucacagauggcagcgcuuccggcgugucugaaugccgcuuucugaaaauuagagaggggcggaucaucaaggagauuuucccgaccggacgcgucaagcacaccgaagaguguacaugcggcuuugccagcaauaaaacgaucgaaugugcuugcagagacaacuccuacaccgccaagcggccuuucgugaaacuuaauguugagacagauaccgccgaaauucgccugaugugcacagacaccuaucucgauacgcccagaccuaacgacgggagcaucacaggacccugugagucugauggcgacaagggguccggaggcauuaaaggcggguuugugcaucaacggauggagagcaagaucggacgcugguacucuagaaccaugagcaaaaccgaacggaugggcauggggcuguaugucaaguacgacggagaucccugggcugacuccgaugcgcuggccuucucuggcgugauggugagcaugaaggagccugggugguacuccuuuggcuucgaaaucaaagacaagaaaugcgaugucccguguauuggaaucgagaugguucacgacggcgggaaggaaacauggcauagcgcugccaccgccauuuauugccucaugggaucuggccagcugcuuugggauacagugacggggguggacauggcucuguga

SEQ ID NO: 213511 - RNA, 1401 nt, Artificial Sequence; identical to SEQ ID NO: 213510
  derived and/or modified sequence opt5 from neuraminidase__InfluenzaB__EPI358089

SEQ ID NO: 213512 - RNA, 1401 nt, Artificial Sequence; identical to SEQ ID NO: 211656
  derived and/or modified sequence opt5 from neuraminidase__InfluenzaB__ABL76698

SEQ ID NO: 213513 - RNA, 1401 nt, Artificial Sequence
  derived and/or modified sequence opt5 from neuraminidase__InfluenzaB__AAD42328
augcugcccagcaccauccagacacucacgcuguuccuuaccuccggcggggugcugcucucucuguacgucagcgccucccuuucuuaucugcucuacagcgacauucugcugaaguuuuccccuacagagaucaccgcuccgacaaugccccucgauugcgccaacgcgucuaauguucaagcugugaacagaagcgccaccaaaggaaugacacugcuucugccugaacccgaguggaccuauccucggcucuccugucccggcagcacguuccagaaggcccugcuuauuucuccucaccgcuuuggggaaaccagaggaaauuccgcuccgcugacaauccgggagcccuucauugccugcggcccuaaagaauguaagcauuuugcucucacccacuacgccgcgcagcccgggggauauuacaacggcacacgcgaggacagaaauaaacugcggcaucugaucagcgugaagcucggcaagaucccuaccgucgagaacucuauuuuccacauggccgcuugguccgggagcgccugccaugauggacgcgaauggacguauaucggcguggacgggcccgauucuaaugcucugauuaaaaucaaguacggagaggccuacacagacaccuaucacuccuacgcgaacaauauucuuagaacacaggaaagcgccuguaacugcaucggcggggauuguuaucugaugauuaccgacggauccgcuucuggcaucagcaaaugccgguuucucaagauccgcgagggcagaauuaucaaagagauuuucccgaccgggcggguugaacacacagaggaauguacgugcggauuugccuccaauaagaccaucgagugugcuugccgcgauaacagcuacacagccaagagaccuuucgugaaacugaaugucgaaaccgacacagccgagauucggcuuaugugcaccgagacguaucuggauacaccccgcccugacgauggcucuaucaccgggcccugugaauccaacggagacaagggcagagggggaaucaaaggcggcuuugugcaucaacggauggcuagcaagauugggagaugguacucucgcaccaugagcaaaacaaagcggaugggaauggagcucuauguuaaauacgacggcgaucccuggaucgacuccgaugcgcuggccccuucuggggugauggucagcauggaggaaccgggaugguacuccuucggcuuugaaauuaaggacaagaaaugcgaugugcccuguaucgggauugagauggugcacgacggcggaaagaaaaccuggcauagcgcugccacagccaucuauugccugaugggcucugggcagcuccugugggauacggucaccggaguugacagauccguguga

SEQ ID NO: 213514 - RNA, 1401 nt, Artificial Sequence; identical to SEQ ID NO: 213199
  derived and/or modified sequence opt5 from neuraminidase__InfluenzaB__EPI541349

SEQ ID NO: 213515 - RNA, 1401 nt, Artificial Sequence; identical to SEQ ID NO: 213398
  derived and/or modified sequence opt5 from neuraminidase__InfluenzaB__EPI541759

SEQ ID NO: 213516 - RNA, 1401 nt, Artificial Sequence; identical to SEQ ID NO: 213491
  derived and/or modified sequence opt5 from neuraminidase__InfluenzaB__EPI826201

SEQ ID NO: 213517 - RNA, 1401 nt, Artificial Sequence; identical to SEQ ID NO: 213230
  derived and/or modified sequence opt5 from neuraminidase__InfluenzaB__EPI477398

SEQ ID NO: 213518 - RNA, 1401 nt, Artificial Sequence; identical to SEQ ID NO: 213230
  derived and/or modified sequence opt5 from neuraminidase__InfluenzaB__EPI492570

SEQ ID NO: 213519 - RNA, 1401 nt, Artificial Sequence; identical to SEQ ID NO: 213230
  derived and/or modified sequence opt5 from neuraminidase__InfluenzaB__EPI498339

SEQ ID NO: 213520 - RNA, 1401 nt, Artificial Sequence; identical to SEQ ID NO: 213451
  derived and/or modified sequence opt5 from neuraminidase__InfluenzaB__EPI538118

SEQ ID NO: 213521 - RNA, 1401 nt, Artificial Sequence; identical to SEQ ID NO: 213451
  derived and/or modified sequence opt5 from neuraminidase__InfluenzaB__EPI538124

SEQ ID NO: 213522 - RNA, 1401 nt, Artificial Sequence; identical to SEQ ID NO: 213451
  derived and/or modified sequence opt5 from neuraminidase__InfluenzaB__EPI556421

SEQ ID NO: 213523 - RNA, 1401 nt, Artificial Sequence; identical to SEQ ID NO: 213451
  derived and/or modified sequence opt5 from neuraminidase__InfluenzaB__EPI614609

SEQ ID NO: 213524 - RNA, 1401 nt, Artificial Sequence; identical to SEQ ID NO: 211695
  derived and/or modified sequence opt5 from neuraminidase__InfluenzaB__BAB32609

SEQ ID NO: 213525 - RNA, 1401 nt, Artificial Sequence; identical to SEQ ID NO: 211841
  derived and/or modified sequence opt5 from neuraminidase__InfluenzaB__EPI271544

SEQ ID NO: 213526 - RNA, 1401 nt, Artificial Sequence; identical to SEQ ID NO: 211841
  derived and/or modified sequence opt5 from neuraminidase__InfluenzaB__AFH57957

SEQ ID NO: 213527 - RNA, 1401 nt, Artificial Sequence; identical to SEQ ID NO: 211841
  derived and/or modified sequence opt5 from neuraminidase__InfluenzaB__EPI294881

SEQ ID NO: 213528 - RNA, 1401 nt, Artificial Sequence; identical to SEQ ID NO: 211696
  derived and/or modified sequence opt5 from neuraminidase__InfluenzaB__ABL77259

SEQ ID NO: 213529 - RNA, 1698 nt, Artificial Sequence
  derived and/or modified sequence opt from Influenza A H1N1 hemagglutinin
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgccccccuccagcuggggaacugcuccgucgccggcuggauccuggggaacccggagugcgagcuccugaucagcaaggaguccuggagcuacaucguggagaagcccaaccccgagaacggcaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgcgaacaacaaggagaaggaggugcucguccuguggggcgugcaccacccgccgaacaucgggaaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgccccgauggacaagugcgacgcgaagugccagaccccccagggggccaucaacagcucccugcccuuccagaacguccacccggugacgaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaagagcacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccugcagugccgcaucugcaucuga

SEQ ID NO: 213530 - RNA, 1701 nt, Artificial Sequence
  derived and/or mutant sequence opt from  Influenza A H1N1 hemagglutinin
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 213531 - RNA, 1701 nt, Artificial Sequence
  derived and/or mutant sequence opt from Influenza A H1N1 hemagglutinin
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagacguucaagcccgagaucgccauccggccgaagguccgcgaccgggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacaucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 213532 - RNA, 1701 nt, Artificial Sequence
  derived and/or mutant sequence opt from Influenza A H1N1 hemagglutinin
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 213533 - RNA, 1701 nt, Artificial Sequence
  derived and/or mutant sequence opt from Influenza A H1N1 hemagglutinin
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 213534 - RNA, 1701 nt, Artificial Sequence
  derived and/or mutant sequence opt from Influenza A H1N1 hemagglutinin
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 213535 - RNA, 1701 nt, Artificial Sequence
  derived and/or mutant sequence opt from Influenza A H1N1 hemagglutinin
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacguccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 213536 - RNA, 1701 nt, Artificial Sequence
  derived and/or modified sequence opt from Influenza A H3N2 hemagglutinin
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccggauccuggacgggaucgacugcacccugaucgacgcccuccugggcgacccccacugcgacgucuuccagaacgagacgugggaccuguucguggagcgcuccaaggccuucagcaacugcuaccccuacgacgugccggacuacgcgucccuccggagccuggucgccuccagcggcacccuggaguucaucaccgagggguucaccuggacgggcgugacccagaacgggggcuccaacgccugcaagcgcgggcccggcagcggcuucuucucccggcucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgcgucaccguguccacgcggcgcagccagcagaccaucauccccaacaucgagagccggcccugggugcgcggccaguccagccggaucuccaucuacuggaccaucgucaagcccggcgacgugcuggugaucaacagcaacgggaaccucaucgcgccgcgcggcuacuucaagaugcggaccgggaaguccagcaucaugcgcuccgacgcccccaucgacacgugcaucagcgagugcaucacccccaacggcuccauccccaacgacaagccguuccagaacgucaacaagaucaccuacggggccugccccaaguacgugaagcagaacacccugaagcuggccacgggcaugcggaacgugcccgagaagcagacccgcggccucuucggggccaucgcgggcuucaucgagaacgggugggagggcaugaucgacgggugguacggcuuccggcaccagaacagcgagggcaccgggcaggccgccgaccugaaguccacccaggccgccaucgaccagaucaacggcaaggucaaccgcaucaucgagaagacgaacgagaaguuccaccagaucgagaaggaguucagcgagguggaggggcggauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcgccggcagcuccgcgagaacgccgaggacaugggcaacgggugcuucaagaucuaccacaagugcgacaacgccugcaucgaguccauccggagcggcaccuacgaccacgacguguaccgggacgaggcccugaacaaccgcuuccagaucaagggcgucgagcugaaguccggguacaaggacuggauccucuggaucagcuucgcgaucuccugcuuccugcugugcguggugcuccugggcuucaucaugugggccugccagcgggggaacauccgcugcaacaucugcaucuga

SEQ ID NO: 213537 - RNA, 1701 nt, Artificial Sequence
  derived and/or modified sequence opt from Influenza A H3N2 hemagglutinin
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 213538 - RNA, 1701 nt, Artificial Sequence
  derived and/or modified sequence opt from Influenza A H3N2 hemagglutinin
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcucuucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 213539 - RNA, 1701 nt, Artificial Sequence
  derived and/or modified sequence opt from Influenza A H3N2 hemagglutinin
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcagcgggcgcaucaccguguccaccaagcggagccagcaggccgugauccccaacaucggcucccgcccccggauccgcgacaucccgagccggaucuccaucuacuggacgaucgucaagccgggcgacauccuccugaucaacagcaccgggaaccugaucgccccgcgcggcuacuucaagauccgguccgggaagagcuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcacuccacgcucaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcugaagagcggcuacaaggacuggauccucuggaucagcuucgccaucuccugcuuccugcugugcguggcccuccugggcuucaucaugugggccugccagaaggggaacauccgcugcaacaucugcaucuga

SEQ ID NO: 213540 - RNA, 1695 nt, Artificial Sequence
  derived and/or modified sequence opt from Influenza A H5N1 hemagglutinin
auggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagacccgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 213541 - RNA, 1707 nt, Artificial Sequence
  derived and/or modified sequence opt from Influenza A H5N1 hemagglutinin
auggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 213542 - RNA, 1683 nt, Artificial Sequence
  derived and/or modified sequence opt from Influenza A H7N9 hemagglutinin
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccggaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccgcccgcaggugaacggccucagcgggcggaucgacuuccacuggcugaugcugaaccccaacgacaccgucaccuucagcuucaacggcgcguucaucgcccccgaccgcgccuccuuccuccgggggaagagcaugggcauccaguccggcgugcagguggacgccaacugcgagggggacugcuaccacagcggcgggacgaucaucuccaaccugcccuuccagaacaucgacagccgcgccgucggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 213543 - RNA, 1701 nt, Artificial Sequence
  derived and/or modified sequence opt from Influenza A H1N1 hemagglutinin
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccggcacaacgggaagcugugcaagcugcgcggcguggccccccuccaccuggggaagugcaacaucgccggcuggcugcucgggaacccggagugcgagcugcuguucaccgcgagcuccuggagcuacaucgucgagaccuccaacagcgacaacggcacgugcuaccccggcgacuucaucaacuacgaggagcuccgggagcagcuguccagcguguccagcuucgagcgcuucgagaucuuccccaaggccuccagcuggcccaaccacgagaccaaccggggcgugaccgccgccugcccguacgcgggggccaacuccuucuaccgcaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagccggagaucgccacccggcccaagguccgcggccaggcgggccggaugaacuacuacuggacccugguggagcccggggacaccaucacguucgaggccaccggcaaccucguggucccccgcuacgccuucgccaugaagcgggggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcgcauggcgaccgggcuccggaacauccccuccauccagagccgcggccuguucggggccaucgccggcuucaucgagggcggguggaccggcaugaucgacgggugguacggcuaccaccaccagaacgagcagggguccggcuacgccgccgaccggaagagcacccagaacgcgaucgacggcaucacgaacaaggugaacuccgugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacaccugcauggagagcgugaagaacgggaccuacgacuaccccaaguacuccgaggagagcaagcucaaccgggaggagaucgacggcgugaagcuggaguccacccgcaucuaccagauccuggccaucuacagcacggucgcguccagccucgugcugcuggugucccucggcgccaucagcuucuggaugugcagcaacgggucccugcagugccggaucugcaucuga

SEQ ID NO: 213544 - RNA, 1698 nt, Artificial Sequence
  derived and/or modified sequence opt from Influenza A H1N1 hemagglutinin
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccggcugaagggcaucgcgccccuccagcuggggaagugcaacaucgccggcuggcugcucgggaacccggagugcgacccccugcugcccgugcgcuccuggagcuacaucgucgagacgcccaacuccgagaacggcaucugcuacccgggcgacuucaucgacuacgaggagcuccgggagcagcugagcuccgugagcuccuucgagcgcuucgagaucuuccccaaggagagcuccuggcccaaccacaacaccaacggggugaccgccgccugcagccacgagggcaaguccagcuucuaccggaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgccccgauguacgcguucgcccucagccggggcuucgggagcggcaucaucacguccaacgccagcaugcacgagugcaacaccaagugccagaccccccugggcgccaucaacuccagccugcccuaccagaacauccacccggugaccaucggggagugccccaaguacgugcgcuccgccaagcuccggauggucacgggccugcgcaacaaccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcuggugucccucggcgcgaucagcuucuggaugugcagcaacgggucccugcagugccgcaucugcaucuga

SEQ ID NO: 213545 - RNA, 1689 nt, Artificial Sequence
  derived and/or modified sequence opt from Influenza A H2N2 hemagglutinin
auggccaucaucuaccugauccuccuguucaccgccgugcggggcgaccagaucugcaucggguaccacgcgaacaacagcaccgagaaggucgacacgauccuggagcgcaacgugaccgugacccacgccaaggacauccucgagaagacccacaacggcaagcugugcaagcugaacgggaucccgccgcucgagcugggcgacugcuccaucgccggguggcugcucggcaaccccgagugcgaccggcugcugagcguccccgagugguccuacaucauggagaaggagaacccccgcgacggccucugcuacccggggagcuucaacgacuacgaggagcugaagcaccugcucuccagcgugaagcacuucgagaaggugaagauccugcccaaggaccgguggacgcagcacaccaccaccggcgggucccgcgccugcgccgucagcggcaaccccuccuucuuccggaacaugguguggcugacggagaaggggagcaacuaccccguggcgaagggcuccuacaacaacaccagcggcgagcagaugcucaucaucuggggcguccaccacccgaacgacgagaccgagcagcgcacccuguaccagaacguggggacguacguguccgucgggaccagcacccugaacaagcgguccacccccgagaucgccacgcgccccaaggugaacggccagggcgggcggauggaguucagcuggacccuccuggacaugugggacaccaucaacuucgaguccaccggcaaccugaucgcccccgaguacggguucaagaucagcaagcgcggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccggaacgugccgcagaucgagucccgcgggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcggcgccucgagaaccugaacaagaagauggaggacggguuccuggacguguggaccuacaacgccgagcuccuggugcugauggagaacgagcggacgcucgacuuccacgacuccaacgucaagaaccuguacgacaaggugcgcaugcagcugcgggacaacgucaaggagcucggcaacgggugcuucgaguucuaccacaagugcgacgacgagugcaugaacagcgugaagaacggcaccuacgacuaccccaaguacgaggaggaguccaagcugaaccgcaacgagaucaagggcgugaagcugagcuccaugggggucuaccagauccucgccaucuacgccaccguggcgggcagccugucccuggccaucaugauggccgggaucagcuucuggaugugcuccaacggcagccugcagugccggaucugcaucuga

SEQ ID NO: 213546 - RNA, 1701 nt, Artificial Sequence
  derived and/or modified sequence opt from Influenza A H3N2 hemagglutinin
augaagaccaucaucgcccugagcuacauccucugccugguguucgcccagaagcugccgggcaacgacaacuccaccgcgacgcucugccuggggcaccacgccgucccgaacggcacccuggugaagaccaucaccaacgaccagaucgaggugacgaacgccaccgagcucguccagagcuccagcaccgggcggaucugcgacuccccccaccgcauccuggacggcaagaacugcacccugaucgacgcccuccugggggacccccacugcgacggcuuccagaacaaggagugggaccuguucaucgagcggagcaaggccuacuccaacugcuaccccuacgacgugccggacuacagcucccuccgcagccugguggcguccagcggcacgcuggaguucaccaacgaggacuucaacuggaccggggucgcccaggacggcggguccuacagcugcaagcgggaguccgugaagagcuucuucucccgccucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgggugaccgucagcaccaaguccagccagcagacggugaucccgaacaucggcucccgccccugggugcggggcaucagcucccgcaucagcaucuacuggaccaucgucaagcccggggacauccuccugaucuccagcaccggcaaccugaucgcgccccggggguacuucaagauccgcaacggcaaguccagcaucaugcgguccgacgccccgaucgacaacugcuacagcgagugcaucacccccaacggcuccauccccaacgacaagcccuuccagaacgugaaccgcaucacguacggggccugcccgaaguacgugaagcagaagacccucaagcuggccaccggcaugcggaacguccccgagaagcagacccgcgggaucuucggcgccaucgcgggguucaucgagaacggcugggagggcaugguggacgggugguacggcuuccggcaccagaacagcgaggggacgggccaggccgccgaccugaaguccacccaggccgccaucgaccaggugaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgcggagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgguuccagaucaagggcguggagcugaagagcggguacaaggacuggauccucuggaucagcuucgcgaucuccugcuuccugcugugcgucgugcuccugggcuucaucaugugggccugccagaagggcaacauccgcugcaacaucugcaucuga

SEQ ID NO: 213547 - RNA, 1701 nt, Artificial Sequence
  derived and/or modified sequence opt from Influenza A H3N2 hemagglutinin
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagccguccgggcgcaucaccgugagcaccaagcggucccagcaggccgugauccccaacaucggcagccgcccccggauccgcaacaucccgagccggaucuccaucuacuggaccaucgucaagcccggcgacauccugcucaucaacagcacggggaaccugaucgccccgcgcggcuacuucaagauccgguccgggaagagcuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcugaagagcggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 213548 - RNA, 1701 nt, Artificial Sequence
  derived and/or modified sequence opt from Influenza A H3N2 hemagglutinin
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacuccccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcuccugcauccgggggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccggaucaccgugagcacgaagcgcagccagcagaccgugauccccaacaucggcucccggccccgcguccggaacauccccagccgcaucuccaucuacuggaccaucgugaagccgggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcaucccgaacgacaagcccuuccagaacgugaaccgcaucaccuacggcgccugcccccgguacgucaagcagaacacccugaagcuggccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcucuucgagaagaccaagaagcagcugcgggagaacgccgaggacaugggcaacgggugcuucaagaucuaccacaagugcgacaacgccugcaucggcagcauccgcaacgggaccuacgaccacgacgucuaccgggacgaggcgcugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 213549 - RNA, 1707 nt, Artificial Sequence
  derived and/or modified sequence opt from Influenza A H5N1 hemagglutinin
auggagaagaucaugcugcuccuggccaucgugagccuggucaaguccgaccagaucugcaucggcuaccacgccaacaacagcaccgagcagguggacaccaucauggagaagaacgugacggucacccacgcgcaggacauccucgagaagacccacaacgggaagcugugcgaccuggacggcgugaagccccucauccugcgggacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccugcugucccgcaucaaccacuucgagaagauccagaucaucccgaagagcuccuggagcgaccacgaggccuccagcggcguguccagcgccugccccuaccagggccgguccagcuucuuccgcaacgucguguggcucaucaagaaggacaacgcguaccccaccaucaagcgguccuacaacaacacgaaccaggaggaccugcuggugcucugggggauccaccaccccaacgacgccgccgagcagacccgccuguaccagaacccgaccaccuacaucagcgucggcacguccacccugaaccagcggcucgugcccaagaucgccacccgcagcaaggugaacgggcaguccggccggauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgugaagagcaaccgccuggugcuggccacggggcuccggaacuccccgcagggcgagcgccggcgcaagaagcggggccuguucggggcgaucgccggcuucaucgagggcggguggcaggggauggucgacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgcgaguucaacaaccuggagcggcgcaucgagaaccucaacaagaagauggaggacggguuccuggacguguggacguacaacgccgagcugcucgugcugauggagaacgagcggacccuggacuuccacgacagcaacgucaagaaccucuacgacaaggugcgccugcagcugcgggacaacgccaaggagcucggcaacggcugcuucgaguucuaccaccgcugcgacaacgagugcauggaguccguccggaacgggaccuacgacuacccccaguacagcgaggaggcccggcugaagcgcgaggagaucuccggcgugaagcuggagagcaucgggaccuaccagauccucuccaucuacagcacgguggccuccagccuggcgcuggccaucauggucgccggccucucccuguggaugugcagcaacgggagccugcagugccggaucugcaucuga

SEQ ID NO: 213550 - RNA, 1704 nt, Artificial Sequence
  derived and/or modified sequence opt from Influenza A H6N1 hemagglutinin
augaucgccaucguggucaucgccauccuggcgagcgccggcaaguccgacaagaucugcaucggguaccacgccaacaacagcaccacccagguggacacgcuccuggagaagaacgugaccgucacccacuccguggagcugcucgagaaccagaaggagaagcgcuucugcaagaucaugaacaaggccccgcuggaccugaaggacugcaccaucgagggcuggauccucgggaacccgaagugcgaccugcugcucggcgaccagagcugguccuacaucguggagcggcccaacgcccagaacgggaucugcuaccccggcguccugaacgagcuggaggagcucaaggcguucaucggcagcggggagcgcguggagcgguucgagauguuccccaaguccacgugggccggcguggacaccagccgcggggucaccaacgccugcccguccuacaccaucgacagcuccuucuaccggaaccugguguggaucgugaagacggacagcgccaccuaccccgucaucaagggcaccuacaacaacaccgggacgcagcccauccuguacuucuggggcgugcaccacccccucgacaccaccgugcaggacaaccuguacggcuccggggacaaguacguccgcaugggcaccgagagcaugaacuucgcgaaguccccggagaucgccgcccggcccgccgugaacgggcagcgcagccggaucgacuacuacugguccgugcugcgccccggcgagacgcucaacgucgagagcaacggcaaccugaucgcccccugguacgcguacaaguucguguccaccaacaagaagggggccguguucaagagcgaccugccgaucgagaacugcgacgccaccugccagaccaucacgggcguccuccggaccaacaagaccuuccagaacgugagcccccuguggaucggggagugccccaaguacgugaaguccgagagccugcgccucgccaccggccugcggaacgucccccagaucgccacgcgcgggaucuucggcgcgaucgccggcuucaucgagggcggguggaccgggaugaucgacggcugguacggguaccaccacgagaacucccagggcagcggcuacgccgccgaccgggaguccacccagaaggccaucgacgggaucaccaacaaggugaacagcaucaucaacaagaugaacacgcaguucgaggcggucgaccacgaguucuccaaccuggagcgccggaucggcaaccucaacaagcgcauggaggacggguuccuggacguguggaccuacaacgccgagcugcucgugcugcuggagaacgagcggacccucgaccugcacgacgccaacgucaagaaccuguacgagaaggugaagagccagcuccgcgacaacgccaacgaccugggcaacgggugcuucgaguucuggcacaagugcgacaacgagugcauggaguccgugaagaacggcaccuacgacuacccgaaguaccagaaggagagcaagcugaaccggcagggcaucgaguccgucaagcucgagaaccuggggguguaccagauccuggccaucuacagcacgguguccagcucccucguccuggugggccugaucauggcgaucgggcucuggaugugcagcaacggcuccaugcagugccgcaucugcaucuga

SEQ ID NO: 213551 - RNA, 1758 nt, Artificial Sequence
  derived and/or modified sequence from Influenza B hemagglutinin
augaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 213552 - RNA, 1755 nt, Artificial Sequence
  derived and/or modified sequence opt from Influenza B hemagglutinin
augaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 213553 - RNA, 1755 nt, Artificial Sequence
  derived and/or modified sequence opt from Influenza B hemagglutinin
augaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 213554 - RNA, 1755 nt, Artificial Sequence
  derived and/or modified sequence from Influenza B hemagglutinin
augaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccaccaagagccacuucgccaaccugaaggggacgcagacccggggcaagcucugccccaacugcuucaacugcaccgaccuggacguggcccuggggcgccccaagugcaugggcaacaccccguccgccaaggugagcauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgcccggcgggcccuacaaggugggcaccagcggguccugccccaacgucgccaacggcaacggcuucuucaacaccauggccugggugauccccaaggacaacaacaagaccgccaucaaccccgugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacuaccugagcgagcucgaggucaagaaccugcagcggcuguccggcgcgaugaacgagcuccacgacgagauccuggagcuggacgagaagguggacgaccuccgcgccgacaccaucagcucccagaucgagcuggccgugcugcucagcaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacggccuggacaaccacacgauccugcuguacuacagcaccgccgccuccagccucgccgugacccugaugaucgccaucuucaucguguacauggucucccgggacaacgugagcugcuccaucugccuguga

SEQ ID NO: 213555 - RNA, 1755 nt, Artificial Sequence
  derived and/or modified sequence from Influenza B hemagglutinin
augaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccacccggagccacuucgccaaccugaaggggacgcagacccggggcaagcucugccccaacugcuucaacugcaccgaccuggacguggcccuggggcgccccaagugcaugggcaacaucccguccgccaaggugagcauccuccacgaggucaagcccgugacguccggcugcuuccccaucaugcacgaccggaccaagauccgccagcugcccaaccugcuccggggguacgagaacauccgccugagcaccuccaacgugaucaacgccgagacggcgcccggcgggcccuacaaggugggcaccagcggguccugccccaacgucgccaaccgcaacggcuucuucaacaccauggccugggugauccccaaggacaacaacaagaccgccaucaaccccgugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacagccugagcgagcucgaggucaagaaccugcagcggcuguccggcgcgaugaacggccuccacgacgagauccuggagcuggacgagaagguggacgaccuccgcgccgacaccaucagcucccagaucgagcuggccgugcugcucagcaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacgaccuggacaaccacacgauccugcuguacuacagcaccgccgccuccagccucgccgugacccugaugaucgccaucuucaucguguacauggucucccgggacaacgugagcugcuccaucugccuguga

SEQ ID NO: 213556 - RNA, 1755 nt, Artificial Sequence
  derived and/or modified sequence from Influenza B hemagglutinin
augaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacgacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagccguacuacaccggggagcacgccaaggccaucggcaacugccccaucugggucaagaccccgcugaagcuggcgaacggcaccaaguaccgcccgcccgccaagcuccugaaggagcggggguucuucggcgccaucgccggguuccuggagggcgggugggagggcaugaucgccggcuggcacggguacacgagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccugcuggcccucgagcgcaagcugaagaagaugcuggggccguccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccugaacgacgacggccucgacaaccacacgauccugcuguacuacuccaccgccgccagcucccucgccgugacccugaugcuggccaucuucaucgucuacauggugagccgcgacaacguguccugcagcaucugccucuga

SEQ ID NO: 213557 - RNA, 1365 nt, Artificial Sequence
  derived and/or mutant sequence opt from Influenza A H1N1 neuraminidase
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccggggcugggccaucuacagcaaggacaacuccauccgcaucggcagcaagggggacgucuucgugauccgggagcccuucaucuccugcagccaccuggagugccgcaccuucuuccucacccagggcgcccugcugaacgacaagcacuccagcgggacggugaaggaccggucccccuaccgcgcgcucaugagcugccccgucggcgaggccccgucccccuacaacagccgguucgagagcguggccugguccgccagcgccugccacgacgggaugggcuggcugaccaucggcaucuccgggcccgacaacggcgcgguggccguccugaaguacaacgggaucaucaccgagaccaucaagagcuggcgcaagaagauccuccggacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgcgacaacuggcacggcagcaaccggcccuggguguccuucgaccagaaccucgacuaccagaucggguacaucugcagcggcgucuucggcgacaacccccgcccggaggacgggaccggcuccugcgggcccguguacguggacggcgccaacggggucaagggcuucagcuaccgguacggcaacgggguguggaucggccgcaccaagucccacagcucccggcacggguucgagaugaucugggaccccaacggcuggaccgagacggacagcaaguucagcgugcgccaggacgucguggccaugaccgacugguccggguacagcggcuccuucgugcagcaccccgagcugaccggccuggacugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaaguga

SEQ ID NO: 213558 - RNA, 1890 nt, Artificial Sequence
  R1425 mRNA product opt Design4 from Influenza A H1N1 hemagglutinin
gggagaaagcuuaccaugaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgccccccuccagcuggggaacugcuccgucgccggcuggauccuggggaacccggagugcgagcuccugaucagcaaggaguccuggagcuacaucguggagaagcccaaccccgagaacggcaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgcgaacaacaaggagaaggaggugcucguccuguggggcgugcaccacccgccgaacaucgggaaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgccccgauggacaagugcgacgcgaagugccagaccccccagggggccaucaacagcucccugcccuuccagaacguccacccggugacgaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaagagcacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 213559 - RNA, 1915 nt, Artificial Sequence
  R1752 mRNA product opt Design1 from Influenza A H1N1 hemagglutinin
gggagaaagcuuaccaugaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgccccccuccagcuggggaacugcuccgucgccggcuggauccuggggaacccggagugcgagcuccugaucagcaaggaguccuggagcuacaucguggagaagcccaaccccgagaacggcaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgcgaacaacaaggagaaggaggugcucguccuguggggcgugcaccacccgccgaacaucgggaaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgccccgauggacaagugcgacgcgaagugccagaccccccagggggccaucaacagcucccugcccuuccagaacguccacccggugacgaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaagagcacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213560 - RNA, 2080 nt, Artificial Sequence
  R5069 mRNA product opt Design2 from Influenza A H1N1 hemagglutinin
ggggcgcugccuacggagguggcagccaucuccuucucggcaucaagcuuaccaugaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgccccccuccagcuggggaacugcuccgucgccggcuggauccuggggaacccggagugcgagcuccugaucagcaaggaguccuggagcuacaucguggagaagcccaaccccgagaacggcaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgcgaacaacaaggagaaggaggugcucguccuguggggcgugcaccacccgccgaacaucgggaaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgccccgauggacaagugcgacgcgaagugccagaccccccagggggccaucaacagcucccugcccuuccagaacguccacccggugacgaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaagagcacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213561 - RNA, 1918 nt, Artificial Sequence
  R1549/R2512 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213562 - RNA, 2083 nt, Artificial Sequence
  R3309/R3310 mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213563 - RNA, 1921 nt, Artificial Sequence
  mRNA product opt Design1 from Influenza A H1N1 hemagglutinin
gggagaaagcuuaccaugaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213564 - RNA, 2086 nt, Artificial Sequence
  mRNA product opt Design2 from Influenza A H1N1 hemagglutinin
ggggcgcugccuacggagguggcagccaucuccuucucggcaucaagcuuaccaugaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213565 - RNA, 1921 nt, Artificial Sequence
  mRNA product opt Design1 from Influenza A H1N1 hemagglutinin
gggagaaagcuuaccauggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213566 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213567 - RNA, 1939 nt, Artificial Sequence
  mRNA product opt Design1 from Influenza A H1N1 hemagglutinin
gggagaaagcuuaccaugcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213568 - RNA, 2104 nt, Artificial Sequence
  mRNA product opt Design2 from Influenza A H1N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213569 - RNA, 1939 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213570 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213571 - RNA, 1918 nt, Artificial Sequence
  R2398/R2514 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagacguucaagcccgagaucgccauccggccgaagguccgcgaccgggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacaucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213572 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagacguucaagcccgagaucgccauccggccgaagguccgcgaccgggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacaucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213573 - RNA, 1918 nt, Artificial Sequence
  R5218 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213574 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213575 - RNA, 1918 nt, Artificial Sequence
  R5219 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213576 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213577 - RNA, 1918 nt, Artificial Sequence
  mRNA product opt Design1 from Influenza A H1N1 hemagglutinin
gggagaaagcuuaccaugaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213578 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213579 - RNA, 1921 nt, Artificial Sequence
  mRNA product opt Design1 from Influenza A H1N1 hemagglutinin
gggagaaagcuuaccaugaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213580 - RNA, 2086 nt, Artificial Sequence
  mRNA product opt Design2 from Influenza A H1N1 hemagglutinin
ggggcgcugccuacggagguggcagccaucuccuucucggcaucaagcuuaccaugaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213581 - RNA, 1921 nt, Artificial Sequence
  mRNA product opt Design1 from Influenza A H1N1 hemagglutinin
gggagaaagcuuaccauggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213582 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213583 - RNA, 1939 nt, Artificial Sequence
  mRNA product opt Design1 from Influenza A H1N1 hemagglutinin
gggagaaagcuuaccaugcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213584 - RNA, 2104 nt, Artificial Sequence
  mRNA product opt Design2 from Influenza A H1N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213585 - RNA, 1939 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213586 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213587 - RNA, 1918 nt, Artificial Sequence
  mRNA product opt Design1 from Influenza A H1N1 hemagglutinin
gggagaaagcuuaccaugaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213588 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213589 - RNA, 1921 nt, Artificial Sequence
  mRNA product opt Design1 from Influenza A H1N1 hemagglutinin
gggagaaagcuuaccaugaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213590 - RNA, 2086 nt, Artificial Sequence
  mRNA product opt Design2 from Influenza A H1N1 hemagglutinin
ggggcgcugccuacggagguggcagccaucuccuucucggcaucaagcuuaccaugaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213591 - RNA, 1921 nt, Artificial Sequence
  mRNA product opt Design1 from Influenza A H1N1 hemagglutinin
gggagaaagcuuaccauggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213592 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213593 - RNA, 1939 nt, Artificial Sequence
  mRNA product opt Design1 from Influenza A H1N1 hemagglutinin
gggagaaagcuuaccaugcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213594 - RNA, 2104 nt, Artificial Sequence
  mRNA product opt Design2 from Influenza A H1N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213595 - RNA, 1939 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213596 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213597 - RNA, 1918 nt, Artificial Sequence
  mRNA product opt Design1 from Influenza A H1N1 hemagglutinin
gggagaaagcuuaccaugaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213598 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213599 - RNA, 1921 nt, Artificial Sequence
  mRNA product opt Design1 from Influenza A H1N1 hemagglutinin
gggagaaagcuuaccaugaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213600 - RNA, 2086 nt, Artificial Sequence
  mRNA product opt Design2 from Influenza A H1N1 hemagglutinin
ggggcgcugccuacggagguggcagccaucuccuucucggcaucaagcuuaccaugaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213601 - RNA, 1921 nt, Artificial Sequence
  mRNA product opt Design1 from Influenza A H1N1 hemagglutinin
gggagaaagcuuaccauggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213602 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213603 - RNA, 1939 nt, Artificial Sequence
  mRNA product opt Design1 from Influenza A H1N1 hemagglutinin
gggagaaagcuuaccaugcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213604 - RNA, 2104 nt, Artificial Sequence
  mRNA product opt Design2 from Influenza A H1N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213605 - RNA, 1939 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213606 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213607 - RNA, 1918 nt, Artificial Sequence
  R4542/R4563 mRNA product Design1 from Influenza A H1N1 hemagglutinin
gggagaaagcuuaccaugaaggcaauacucguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaagaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacccuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggcggguggacagggaugguagauggaugguacgguuaucaccaucaaaaugagcaggggucaggauaugcagccgaccucaagagcacacagaaugccauugacgagauuacuaacaaaguaaauucuguuauugaaaagaugaauacacaguucacagcaguagguaaagaguucaaccaccuggaaaagagaauagagaauuuaaauaagaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaagaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213608 - RNA, 2083 nt, Artificial Sequence
  mRNA product Design2 from Influenza A H1N1 hemagglutinin
ggggcgcugccuacggagguggcagccaucuccuucucggcaucaagcuuaccaugaaggcaauacucguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaagaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacccuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggcggguggacagggaugguagauggaugguacgguuaucaccaucaaaaugagcaggggucaggauaugcagccgaccucaagagcacacagaaugccauugacgagauuacuaacaaaguaaauucuguuauugaaaagaugaauacacaguucacagcaguagguaaagaguucaaccaccuggaaaagagaauagagaauuuaaauaagaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaagaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213609 - RNA, 1893 nt, Artificial Sequence
  R1444 mRNA product opt Design4 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 213610 - RNA, 1918 nt, Artificial Sequence
  R1548 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213611 - RNA, 2083 nt, Artificial Sequence
  R2564 mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213612 - RNA, 1921 nt, Artificial Sequence
  mRNA product opt Design1 from Influenza A H1N1 hemagglutinin
gggagaaagcuuaccaugaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213613 - RNA, 2086 nt, Artificial Sequence
  mRNA product opt Design2 from Influenza A H1N1 hemagglutinin
ggggcgcugccuacggagguggcagccaucuccuucucggcaucaagcuuaccaugaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213614 - RNA, 1921 nt, Artificial Sequence
  mRNA product opt Design1 from Influenza A H1N1 hemagglutinin
gggagaaagcuuaccauggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213615 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213616 - RNA, 1939 nt, Artificial Sequence
  mRNA product opt Design1 from Influenza A H1N1 hemagglutinin
gggagaaagcuuaccaugcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213617 - RNA, 2104 nt, Artificial Sequence
  mRNA product opt Design2 from Influenza A H1N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213618 - RNA, 1939 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213619 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213620 - RNA, 1893 nt, Artificial Sequence
  R2399 mRNA product opt Design4 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacguccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 213621 - RNA, 1918 nt, Artificial Sequence
  R2199/R2513 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacguccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213622 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacguccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213623 - RNA, 1918 nt, Artificial Sequence
  R1805 mRNA product opt Design1 from Influenza A H3N2 hemagglutinin
gggagaaagcuuaccaugaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccggauccuggacgggaucgacugcacccugaucgacgcccuccugggcgacccccacugcgacgucuuccagaacgagacgugggaccuguucguggagcgcuccaaggccuucagcaacugcuaccccuacgacgugccggacuacgcgucccuccggagccuggucgccuccagcggcacccuggaguucaucaccgagggguucaccuggacgggcgugacccagaacgggggcuccaacgccugcaagcgcgggcccggcagcggcuucuucucccggcucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgcgucaccguguccacgcggcgcagccagcagaccaucauccccaacaucgagagccggcccugggugcgcggccaguccagccggaucuccaucuacuggaccaucgucaagcccggcgacgugcuggugaucaacagcaacgggaaccucaucgcgccgcgcggcuacuucaagaugcggaccgggaaguccagcaucaugcgcuccgacgcccccaucgacacgugcaucagcgagugcaucacccccaacggcuccauccccaacgacaagccguuccagaacgucaacaagaucaccuacggggccugccccaaguacgugaagcagaacacccugaagcuggccacgggcaugcggaacgugcccgagaagcagacccgcggccucuucggggccaucgcgggcuucaucgagaacgggugggagggcaugaucgacgggugguacggcuuccggcaccagaacagcgagggcaccgggcaggccgccgaccugaaguccacccaggccgccaucgaccagaucaacggcaaggucaaccgcaucaucgagaagacgaacgagaaguuccaccagaucgagaaggaguucagcgagguggaggggcggauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcgccggcagcuccgcgagaacgccgaggacaugggcaacgggugcuucaagaucuaccacaagugcgacaacgccugcaucgaguccauccggagcggcaccuacgaccacgacguguaccgggacgaggcccugaacaaccgcuuccagaucaagggcgucgagcugaaguccggguacaaggacuggauccucuggaucagcuucgcgaucuccugcuuccugcugugcguggugcuccugggcuucaucaugugggccugccagcgggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213624 - RNA, 2083 nt, Artificial Sequence
  R5071 mRNA product opt Design2 from Influenza A H3N2 hemagglutinin
ggggcgcugccuacggagguggcagccaucuccuucucggcaucaagcuuaccaugaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccggauccuggacgggaucgacugcacccugaucgacgcccuccugggcgacccccacugcgacgucuuccagaacgagacgugggaccuguucguggagcgcuccaaggccuucagcaacugcuaccccuacgacgugccggacuacgcgucccuccggagccuggucgccuccagcggcacccuggaguucaucaccgagggguucaccuggacgggcgugacccagaacgggggcuccaacgccugcaagcgcgggcccggcagcggcuucuucucccggcucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgcgucaccguguccacgcggcgcagccagcagaccaucauccccaacaucgagagccggcccugggugcgcggccaguccagccggaucuccaucuacuggaccaucgucaagcccggcgacgugcuggugaucaacagcaacgggaaccucaucgcgccgcgcggcuacuucaagaugcggaccgggaaguccagcaucaugcgcuccgacgcccccaucgacacgugcaucagcgagugcaucacccccaacggcuccauccccaacgacaagccguuccagaacgucaacaagaucaccuacggggccugccccaaguacgugaagcagaacacccugaagcuggccacgggcaugcggaacgugcccgagaagcagacccgcggccucuucggggccaucgcgggcuucaucgagaacgggugggagggcaugaucgacgggugguacggcuuccggcaccagaacagcgagggcaccgggcaggccgccgaccugaaguccacccaggccgccaucgaccagaucaacggcaaggucaaccgcaucaucgagaagacgaacgagaaguuccaccagaucgagaaggaguucagcgagguggaggggcggauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcgccggcagcuccgcgagaacgccgaggacaugggcaacgggugcuucaagaucuaccacaagugcgacaacgccugcaucgaguccauccggagcggcaccuacgaccacgacguguaccgggacgaggcccugaacaaccgcuuccagaucaagggcgucgagcugaaguccggguacaaggacuggauccucuggaucagcuucgcgaucuccugcuuccugcugugcguggugcuccugggcuucaucaugugggccugccagcgggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213625 - RNA, 1918 nt, Artificial Sequence
  R4936/R5226 mRNA product opt Design1 from Influenza A H3N2 hemagglutinin
gggagaaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213626 - RNA, 2083 nt, Artificial Sequence
  R5072 mRNA product opt Design2 from Influenza A H3N2 hemagglutinin
ggggcgcugccuacggagguggcagccaucuccuucucggcaucaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213627 - RNA, 1924 nt, Artificial Sequence
  mRNA product opt Design1 from Influenza A H3N2 hemagglutinin
gggagaaagcuuaccaugaagugggugaccuucaucagccugcucuuccuguucuccagcgccuacucccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213628 - RNA, 2089 nt, Artificial Sequence
  mRNA product opt Design2 from Influenza A H3N2 hemagglutinin
ggggcgcugccuacggagguggcagccaucuccuucucggcaucaagcuuaccaugaagugggugaccuucaucagccugcucuuccuguucuccagcgccuacucccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213629 - RNA, 1924 nt, Artificial Sequence
  mRNA product opt Design1 from Influenza A H3N2 hemagglutinin
gggagaaagcuuaccauggacuggaccuggauccuguuccucguggccgccgcgacccgcguccacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213630 - RNA, 2089 nt, Artificial Sequence
  mRNA product opt Design2 from Influenza A H3N2 hemagglutinin
ggggcgcugccuacggagguggcagccaucuccuucucggcaucaagcuuaccauggacuggaccuggauccuguuccucguggccgccgcgacccgcguccacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213631 - RNA, 1942 nt, Artificial Sequence
  mRNA product opt Design1 from Influenza A H3N2 hemagglutinin
gggagaaagcuuaccaugcccaugggcagccugcagccgcucgccacccuguaccugcucgggaugcugguggccuccugccugggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213632 - RNA, 2107 nt, Artificial Sequence
  mRNA product opt Design2 from Influenza A H3N2 hemagglutinin
ggggcgcugccuacggagguggcagccaucuccuucucggcaucaagcuuaccaugcccaugggcagccugcagccgcucgccacccuguaccugcucgggaugcugguggccuccugccugggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213633 - RNA, 1942 nt, Artificial Sequence
  mRNA product opt Design1 from Influenza A H3N2 hemagglutinin
gggagaaagcuuaccauggccgugauggccccgcggacccugguccuccugcugagcggcgcgcucgcccugacccagacgugggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213634 - RNA, 2107 nt, Artificial Sequence
  mRNA product opt Design2 from Influenza A H3N2 hemagglutinin
ggggcgcugccuacggagguggcagccaucuccuucucggcaucaagcuuaccauggccgugauggccccgcggacccugguccuccugcugagcggcgcgcucgcccugacccagacgugggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213635 - RNA, 1918 nt, Artificial Sequence
  R4937 mRNA product opt Design1 from Influenza A H3N2 hemagglutinin
gggagaaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcucuucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213636 - RNA, 2083 nt, Artificial Sequence
  R5073 mRNA product opt Design2 from Influenza A H3N2 hemagglutinin
ggggcgcugccuacggagguggcagccaucuccuucucggcaucaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcucuucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213637 - RNA, 1918 nt, Artificial Sequence
  R4938 mRNA product opt Design1 from Influenza A H3N2 hemagglutinin
gggagaaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcagcgggcgcaucaccguguccaccaagcggagccagcaggccgugauccccaacaucggcucccgcccccggauccgcgacaucccgagccggaucuccaucuacuggacgaucgucaagccgggcgacauccuccugaucaacagcaccgggaaccugaucgccccgcgcggcuacuucaagauccgguccgggaagagcuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcacuccacgcucaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcugaagagcggcuacaaggacuggauccucuggaucagcuucgccaucuccugcuuccugcugugcguggcccuccugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213638 - RNA, 2083 nt, Artificial Sequence
  R5074 mRNA product opt Design2 from Influenza A H3N2 hemagglutinin
ggggcgcugccuacggagguggcagccaucuccuucucggcaucaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcagcgggcgcaucaccguguccaccaagcggagccagcaggccgugauccccaacaucggcucccgcccccggauccgcgacaucccgagccggaucuccaucuacuggacgaucgucaagccgggcgacauccuccugaucaacagcaccgggaaccugaucgccccgcgcggcuacuucaagauccgguccgggaagagcuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcacuccacgcucaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcugaagagcggcuacaaggacuggauccucuggaucagcuucgccaucuccugcuuccugcugugcguggcccuccugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213639 - RNA, 1887 nt, Artificial Sequence
  R2256 mRNA product opt Design4 from Influenza A H5N1 hemagglutinin
gggagaaagcuuaccauggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagacccgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 213640 - RNA, 1912 nt, Artificial Sequence
  R1686/R2402 mRNA product opt Design1 from Influenza A H5N1 hemagglutinin
gggagaaagcuuaccauggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagacccgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213641 - RNA, 2077 nt, Artificial Sequence
  R2284/R3096 mRNA product opt Design2 from Influenza A H5N1 hemagglutinin
ggggcgcugccuacggagguggcagccaucuccuucucggcaucaagcuuaccauggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagacccgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213642 - RNA, 1924 nt, Artificial Sequence
  R2259mRNA product Design1 from Influenza A H5N1 hemagglutinin
gggagaaagcuuaccauggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauuuaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucuacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaacgagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213643 - RNA, 2089 nt, Artificial Sequence
  mRNA product Design2 from Influenza A H5N1 hemagglutinin
ggggcgcugccuacggagguggcagccaucuccuucucggcaucaagcuuaccauggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauuuaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucuacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaacgagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213644 - RNA, 1924 nt, Artificial Sequence
  R1688/R5227 mRNA product opt Design1 from Influenza A H5N1 hemagglutinin
gggagaaagcuuaccauggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213645 - RNA, 2089 nt, Artificial Sequence
  R2292 mRNA product opt Design2 from Influenza A H5N1 hemagglutinin
ggggcgcugccuacggagguggcagccaucuccuucucggcaucaagcuuaccauggagaagaucgugcugcucuucgccaucgucagccuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213646 - RNA, 1900 nt, Artificial Sequence
  R5224 mRNA product opt Design1 from Influenza A H9N2 hemagglutinin
gggagaaagcuuaccaugaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccggaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccgcccgcaggugaacggccucagcgggcggaucgacuuccacuggcugaugcugaaccccaacgacaccgucaccuucagcuucaacggcgcguucaucgcccccgaccgcgccuccuuccuccgggggaagagcaugggcauccaguccggcgugcagguggacgccaacugcgagggggacugcuaccacagcggcgggacgaucaucuccaaccugcccuuccagaacaucgacagccgcgccgucggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213647 - RNA, 1930 nt, Artificial Sequence
  mRNA product opt Design1 from Influenza A H5N1 hemagglutinin
gggagaaagcuuaccaugaagugggugaccuucaucagccugcucuuccuguucuccagcgccuacuccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213648 - RNA, 2095 nt, Artificial Sequence
  mRNA product opt Design2 from Influenza A H5N1 hemagglutinin
ggggcgcugccuacggagguggcagccaucuccuucucggcaucaagcuuaccaugaagugggugaccuucaucagccugcucuuccuguucuccagcgccuacuccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213649 - RNA, 1930 nt, Artificial Sequence
  mRNA product opt Design1 from Influenza A H5N1 hemagglutinin
gggagaaagcuuaccauggacuggaccuggauccuguuccucguggccgccgcgacccgcguccacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213650 - RNA, 2095 nt, Artificial Sequence
  mRNA product opt Design2 from Influenza A H5N1 hemagglutinin
ggggcgcugccuacggagguggcagccaucuccuucucggcaucaagcuuaccauggacuggaccuggauccuguuccucguggccgccgcgacccgcguccacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213651 - RNA, 1948 nt, Artificial Sequence
  mRNA product opt Design1 from Influenza A H5N1 hemagglutinin
gggagaaagcuuaccaugcccaugggcagccugcagccgcucgccacccuguaccugcucgggaugcugguggccuccugccugggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213652 - RNA, 2113 nt, Artificial Sequence
  mRNA product opt Design2 from Influenza A H5N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213653 - RNA, 1948 nt, Artificial Sequence
  mRNA product opt Design1 from Influenza A H5N1 hemagglutinin
gggagaaagcuuaccauggccgugauggccccgcggacccugguccuccugcugagcggcgcgcucgcccugacccagacgugggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213654 - RNA, 2113 nt, Artificial Sequence
  mRNA product opt Design2 from Influenza A H5N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213655 - RNA, 2065 nt, Artificial Sequence
  R3217/R3218 mRNA product opt Design2 from Influenza A H7N9 hemagglutinin
ggggcgcugccuacggagguggcagccaucuccuucucggcaucaagcuuaccaugaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccggaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccgcccgcaggugaacggccucagcgggcggaucgacuuccacuggcugaugcugaaccccaacgacaccgucaccuucagcuucaacggcgcguucaucgcccccgaccgcgccuccuuccuccgggggaagagcaugggcauccaguccggcgugcagguggacgccaacugcgagggggacugcuaccacagcggcgggacgaucaucuccaaccugcccuuccagaacaucgacagccgcgccgucggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213656 - RNA, 1905 nt, Artificial Sequence
  R1072 mRNA product opt Design3 from Influenza A H1N1 hemagglutinin
gggagaaagcuuaccaugaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccggcacaacgggaagcugugcaagcugcgcggcguggccccccuccaccuggggaagugcaacaucgccggcuggcugcucgggaacccggagugcgagcugcuguucaccgcgagcuccuggagcuacaucgucgagaccuccaacagcgacaacggcacgugcuaccccggcgacuucaucaacuacgaggagcuccgggagcagcuguccagcguguccagcuucgagcgcuucgagaucuuccccaaggccuccagcuggcccaaccacgagaccaaccggggcgugaccgccgccugcccguacgcgggggccaacuccuucuaccgcaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagccggagaucgccacccggcccaagguccgcggccaggcgggccggaugaacuacuacuggacccugguggagcccggggacaccaucacguucgaggccaccggcaaccucguggucccccgcuacgccuucgccaugaagcgggggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcgcauggcgaccgggcuccggaacauccccuccauccagagccgcggccuguucggggccaucgccggcuucaucgagggcggguggaccggcaugaucgacgggugguacggcuaccaccaccagaacgagcagggguccggcuacgccgccgaccggaagagcacccagaacgcgaucgacggcaucacgaacaaggugaacuccgugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacaccugcauggagagcgugaagaacgggaccuacgacuaccccaaguacuccgaggagagcaagcucaaccgggaggagaucgacggcgugaagcuggaguccacccgcaucuaccagauccuggccaucuacagcacggucgcguccagccucgugcugcuggugucccucggcgccaucagcuucuggaugugcagcaacgggucccugcagugccggaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 213657 - RNA, 1918 nt, Artificial Sequence
  mRNA product opt Design1 from Influenza A H1N1 hemagglutinin
gggagaaagcuuaccaugaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccggcacaacgggaagcugugcaagcugcgcggcguggccccccuccaccuggggaagugcaacaucgccggcuggcugcucgggaacccggagugcgagcugcuguucaccgcgagcuccuggagcuacaucgucgagaccuccaacagcgacaacggcacgugcuaccccggcgacuucaucaacuacgaggagcuccgggagcagcuguccagcguguccagcuucgagcgcuucgagaucuuccccaaggccuccagcuggcccaaccacgagaccaaccggggcgugaccgccgccugcccguacgcgggggccaacuccuucuaccgcaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagccggagaucgccacccggcccaagguccgcggccaggcgggccggaugaacuacuacuggacccugguggagcccggggacaccaucacguucgaggccaccggcaaccucguggucccccgcuacgccuucgccaugaagcgggggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcgcauggcgaccgggcuccggaacauccccuccauccagagccgcggccuguucggggccaucgccggcuucaucgagggcggguggaccggcaugaucgacgggugguacggcuaccaccaccagaacgagcagggguccggcuacgccgccgaccggaagagcacccagaacgcgaucgacggcaucacgaacaaggugaacuccgugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacaccugcauggagagcgugaagaacgggaccuacgacuaccccaaguacuccgaggagagcaagcucaaccgggaggagaucgacggcgugaagcuggaguccacccgcaucuaccagauccuggccaucuacagcacggucgcguccagccucgugcugcuggugucccucggcgccaucagcuucuggaugugcagcaacgggucccugcagugccggaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213658 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccggcacaacgggaagcugugcaagcugcgcggcguggccccccuccaccuggggaagugcaacaucgccggcuggcugcucgggaacccggagugcgagcugcuguucaccgcgagcuccuggagcuacaucgucgagaccuccaacagcgacaacggcacgugcuaccccggcgacuucaucaacuacgaggagcuccgggagcagcuguccagcguguccagcuucgagcgcuucgagaucuuccccaaggccuccagcuggcccaaccacgagaccaaccggggcgugaccgccgccugcccguacgcgggggccaacuccuucuaccgcaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagccggagaucgccacccggcccaagguccgcggccaggcgggccggaugaacuacuacuggacccugguggagcccggggacaccaucacguucgaggccaccggcaaccucguggucccccgcuacgccuucgccaugaagcgggggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcgcauggcgaccgggcuccggaacauccccuccauccagagccgcggccuguucggggccaucgccggcuucaucgagggcggguggaccggcaugaucgacgggugguacggcuaccaccaccagaacgagcagggguccggcuacgccgccgaccggaagagcacccagaacgcgaucgacggcaucacgaacaaggugaacuccgugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacaccugcauggagagcgugaagaacgggaccuacgacuaccccaaguacuccgaggagagcaagcucaaccgggaggagaucgacggcgugaagcuggaguccacccgcaucuaccagauccuggccaucuacagcacggucgcguccagccucgugcugcuggugucccucggcgccaucagcuucuggaugugcagcaacgggucccugcagugccggaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213659 - RNA, 1902 nt, Artificial Sequence
  R805/R1010 mRNA product opt Design3 from Influenza A H1N1 hemagglutinin
gggagaaagcuuaccaugaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccggcugaagggcaucgcgccccuccagcuggggaagugcaacaucgccggcuggcugcucgggaacccggagugcgacccccugcugcccgugcgcuccuggagcuacaucgucgagacgcccaacuccgagaacggcaucugcuacccgggcgacuucaucgacuacgaggagcuccgggagcagcugagcuccgugagcuccuucgagcgcuucgagaucuuccccaaggagagcuccuggcccaaccacaacaccaacggggugaccgccgccugcagccacgagggcaaguccagcuucuaccggaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgccccgauguacgcguucgcccucagccggggcuucgggagcggcaucaucacguccaacgccagcaugcacgagugcaacaccaagugccagaccccccugggcgccaucaacuccagccugcccuaccagaacauccacccggugaccaucggggagugccccaaguacgugcgcuccgccaagcuccggauggucacgggccugcgcaacaaccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcuggugucccucggcgcgaucagcuucuggaugugcagcaacgggucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 213660 - RNA, 1915 nt, Artificial Sequence
  R1398/R2552 mRNA product opt Design1 from Influenza A H1N1 hemagglutinin
gggagaaagcuuaccaugaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccggcugaagggcaucgcgccccuccagcuggggaagugcaacaucgccggcuggcugcucgggaacccggagugcgacccccugcugcccgugcgcuccuggagcuacaucgucgagacgcccaacuccgagaacggcaucugcuacccgggcgacuucaucgacuacgaggagcuccgggagcagcugagcuccgugagcuccuucgagcgcuucgagaucuuccccaaggagagcuccuggcccaaccacaacaccaacggggugaccgccgccugcagccacgagggcaaguccagcuucuaccggaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgccccgauguacgcguucgcccucagccggggcuucgggagcggcaucaucacguccaacgccagcaugcacgagugcaacaccaagugccagaccccccugggcgccaucaacuccagccugcccuaccagaacauccacccggugaccaucggggagugccccaaguacgugcgcuccgccaagcuccggauggucacgggccugcgcaacaaccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcuggugucccucggcgcgaucagcuucuggaugugcagcaacgggucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213661 - RNA, 2080 nt, Artificial Sequence
  R2567/R2568 mRNA product opt Design2 from Influenza A H1N1 hemagglutinin
ggggcgcugccuacggagguggcagccaucuccuucucggcaucaagcuuaccaugaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccggcugaagggcaucgcgccccuccagcuggggaagugcaacaucgccggcuggcugcucgggaacccggagugcgacccccugcugcccgugcgcuccuggagcuacaucgucgagacgcccaacuccgagaacggcaucugcuacccgggcgacuucaucgacuacgaggagcuccgggagcagcugagcuccgugagcuccuucgagcgcuucgagaucuuccccaaggagagcuccuggcccaaccacaacaccaacggggugaccgccgccugcagccacgagggcaaguccagcuucuaccggaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgccccgauguacgcguucgcccucagccggggcuucgggagcggcaucaucacguccaacgccagcaugcacgagugcaacaccaagugccagaccccccugggcgccaucaacuccagccugcccuaccagaacauccacccggugaccaucggggagugccccaaguacgugcgcuccgccaagcuccggauggucacgggccugcgcaacaaccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcuggugucccucggcgcgaucagcuucuggaugugcagcaacgggucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213662 - RNA, 1906 nt, Artificial Sequence
  R1892/R2477 mRNA product opt Design1 from Influenza A H2N2 hemagglutinin
gggagaaagcuuaccauggccaucaucuaccugauccuccuguucaccgccgugcggggcgaccagaucugcaucggguaccacgcgaacaacagcaccgagaaggucgacacgauccuggagcgcaacgugaccgugacccacgccaaggacauccucgagaagacccacaacggcaagcugugcaagcugaacgggaucccgccgcucgagcugggcgacugcuccaucgccggguggcugcucggcaaccccgagugcgaccggcugcugagcguccccgagugguccuacaucauggagaaggagaacccccgcgacggccucugcuacccggggagcuucaacgacuacgaggagcugaagcaccugcucuccagcgugaagcacuucgagaaggugaagauccugcccaaggaccgguggacgcagcacaccaccaccggcgggucccgcgccugcgccgucagcggcaaccccuccuucuuccggaacaugguguggcugacggagaaggggagcaacuaccccguggcgaagggcuccuacaacaacaccagcggcgagcagaugcucaucaucuggggcguccaccacccgaacgacgagaccgagcagcgcacccuguaccagaacguggggacguacguguccgucgggaccagcacccugaacaagcgguccacccccgagaucgccacgcgccccaaggugaacggccagggcgggcggauggaguucagcuggacccuccuggacaugugggacaccaucaacuucgaguccaccggcaaccugaucgcccccgaguacggguucaagaucagcaagcgcggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccggaacgugccgcagaucgagucccgcgggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcggcgccucgagaaccugaacaagaagauggaggacggguuccuggacguguggaccuacaacgccgagcuccuggugcugauggagaacgagcggacgcucgacuuccacgacuccaacgucaagaaccuguacgacaaggugcgcaugcagcugcgggacaacgucaaggagcucggcaacgggugcuucgaguucuaccacaagugcgacgacgagugcaugaacagcgugaagaacggcaccuacgacuaccccaaguacgaggaggaguccaagcugaaccgcaacgagaucaagggcgugaagcugagcuccaugggggucuaccagauccucgccaucuacgccaccguggcgggcagccugucccuggccaucaugauggccgggaucagcuucuggaugugcuccaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213663 - RNA, 2071 nt, Artificial Sequence
  R5070 mRNA product opt Design2 from Influenza A H2N2 hemagglutinin
ggggcgcugccuacggagguggcagccaucuccuucucggcaucaagcuuaccauggccaucaucuaccugauccuccuguucaccgccgugcggggcgaccagaucugcaucggguaccacgcgaacaacagcaccgagaaggucgacacgauccuggagcgcaacgugaccgugacccacgccaaggacauccucgagaagacccacaacggcaagcugugcaagcugaacgggaucccgccgcucgagcugggcgacugcuccaucgccggguggcugcucggcaaccccgagugcgaccggcugcugagcguccccgagugguccuacaucauggagaaggagaacccccgcgacggccucugcuacccggggagcuucaacgacuacgaggagcugaagcaccugcucuccagcgugaagcacuucgagaaggugaagauccugcccaaggaccgguggacgcagcacaccaccaccggcgggucccgcgccugcgccgucagcggcaaccccuccuucuuccggaacaugguguggcugacggagaaggggagcaacuaccccguggcgaagggcuccuacaacaacaccagcggcgagcagaugcucaucaucuggggcguccaccacccgaacgacgagaccgagcagcgcacccuguaccagaacguggggacguacguguccgucgggaccagcacccugaacaagcgguccacccccgagaucgccacgcgccccaaggugaacggccagggcgggcggauggaguucagcuggacccuccuggacaugugggacaccaucaacuucgaguccaccggcaaccugaucgcccccgaguacggguucaagaucagcaagcgcggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccggaacgugccgcagaucgagucccgcgggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcggcgccucgagaaccugaacaagaagauggaggacggguuccuggacguguggaccuacaacgccgagcuccuggugcugauggagaacgagcggacgcucgacuuccacgacuccaacgucaagaaccuguacgacaaggugcgcaugcagcugcgggacaacgucaaggagcucggcaacgggugcuucgaguucuaccacaagugcgacgacgagugcaugaacagcgugaagaacggcaccuacgacuaccccaaguacgaggaggaguccaagcugaaccgcaacgagaucaagggcgugaagcugagcuccaugggggucuaccagauccucgccaucuacgccaccguggcgggcagccugucccuggccaucaugauggccgggaucagcuucuggaugugcuccaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213664 - RNA, 1905 nt, Artificial Sequence
  R1073 mRNA product opt Design3 from Influenza A H3N2hemagglutinin
gggagaaagcuuaccaugaagaccaucaucgcccugagcuacauccucugccugguguucgcccagaagcugccgggcaacgacaacuccaccgcgacgcucugccuggggcaccacgccgucccgaacggcacccuggugaagaccaucaccaacgaccagaucgaggugacgaacgccaccgagcucguccagagcuccagcaccgggcggaucugcgacuccccccaccgcauccuggacggcaagaacugcacccugaucgacgcccuccugggggacccccacugcgacggcuuccagaacaaggagugggaccuguucaucgagcggagcaaggccuacuccaacugcuaccccuacgacgugccggacuacagcucccuccgcagccugguggcguccagcggcacgcuggaguucaccaacgaggacuucaacuggaccggggucgcccaggacggcggguccuacagcugcaagcgggaguccgugaagagcuucuucucccgccucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgggugaccgucagcaccaaguccagccagcagacggugaucccgaacaucggcucccgccccugggugcggggcaucagcucccgcaucagcaucuacuggaccaucgucaagcccggggacauccuccugaucuccagcaccggcaaccugaucgcgccccggggguacuucaagauccgcaacggcaaguccagcaucaugcgguccgacgccccgaucgacaacugcuacagcgagugcaucacccccaacggcuccauccccaacgacaagcccuuccagaacgugaaccgcaucacguacggggccugcccgaaguacgugaagcagaagacccucaagcuggccaccggcaugcggaacguccccgagaagcagacccgcgggaucuucggcgccaucgcgggguucaucgagaacggcugggagggcaugguggacgggugguacggcuuccggcaccagaacagcgaggggacgggccaggccgccgaccugaaguccacccaggccgccaucgaccaggugaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgcggagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgguuccagaucaagggcguggagcugaagagcggguacaaggacuggauccucuggaucagcuucgcgaucuccugcuuccugcugugcgucgugcuccugggcuucaucaugugggccugccagaagggcaacauccgcugcaacaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 213665 - RNA, 1918 nt, Artificial Sequence
  mRNA product opt Design1 from Influenza A H3N2 hemagglutinin
gggagaaagcuuaccaugaagaccaucaucgcccugagcuacauccucugccugguguucgcccagaagcugccgggcaacgacaacuccaccgcgacgcucugccuggggcaccacgccgucccgaacggcacccuggugaagaccaucaccaacgaccagaucgaggugacgaacgccaccgagcucguccagagcuccagcaccgggcggaucugcgacuccccccaccgcauccuggacggcaagaacugcacccugaucgacgcccuccugggggacccccacugcgacggcuuccagaacaaggagugggaccuguucaucgagcggagcaaggccuacuccaacugcuaccccuacgacgugccggacuacagcucccuccgcagccugguggcguccagcggcacgcuggaguucaccaacgaggacuucaacuggaccggggucgcccaggacggcggguccuacagcugcaagcgggaguccgugaagagcuucuucucccgccucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgggugaccgucagcaccaaguccagccagcagacggugaucccgaacaucggcucccgccccugggugcggggcaucagcucccgcaucagcaucuacuggaccaucgucaagcccggggacauccuccugaucuccagcaccggcaaccugaucgcgccccggggguacuucaagauccgcaacggcaaguccagcaucaugcgguccgacgccccgaucgacaacugcuacagcgagugcaucacccccaacggcuccauccccaacgacaagcccuuccagaacgugaaccgcaucacguacggggccugcccgaaguacgugaagcagaagacccucaagcuggccaccggcaugcggaacguccccgagaagcagacccgcgggaucuucggcgccaucgcgggguucaucgagaacggcugggagggcaugguggacgggugguacggcuuccggcaccagaacagcgaggggacgggccaggccgccgaccugaaguccacccaggccgccaucgaccaggugaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgcggagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgguuccagaucaagggcguggagcugaagagcggguacaaggacuggauccucuggaucagcuucgcgaucuccugcuuccugcugugcgucgugcuccugggcuucaucaugugggccugccagaagggcaacauccgcugcaacaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213666 - RNA, 2083 nt, Artificial Sequence
  mRNA product opt Design2 from Influenza A H3N2 hemagglutinin
ggggcgcugccuacggagguggcagccaucuccuucucggcaucaagcuuaccaugaagaccaucaucgcccugagcuacauccucugccugguguucgcccagaagcugccgggcaacgacaacuccaccgcgacgcucugccuggggcaccacgccgucccgaacggcacccuggugaagaccaucaccaacgaccagaucgaggugacgaacgccaccgagcucguccagagcuccagcaccgggcggaucugcgacuccccccaccgcauccuggacggcaagaacugcacccugaucgacgcccuccugggggacccccacugcgacggcuuccagaacaaggagugggaccuguucaucgagcggagcaaggccuacuccaacugcuaccccuacgacgugccggacuacagcucccuccgcagccugguggcguccagcggcacgcuggaguucaccaacgaggacuucaacuggaccggggucgcccaggacggcggguccuacagcugcaagcgggaguccgugaagagcuucuucucccgccucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgggugaccgucagcaccaaguccagccagcagacggugaucccgaacaucggcucccgccccugggugcggggcaucagcucccgcaucagcaucuacuggaccaucgucaagcccggggacauccuccugaucuccagcaccggcaaccugaucgcgccccggggguacuucaagauccgcaacggcaaguccagcaucaugcgguccgacgccccgaucgacaacugcuacagcgagugcaucacccccaacggcuccauccccaacgacaagcccuuccagaacgugaaccgcaucacguacggggccugcccgaaguacgugaagcagaagacccucaagcuggccaccggcaugcggaacguccccgagaagcagacccgcgggaucuucggcgccaucgcgggguucaucgagaacggcugggagggcaugguggacgggugguacggcuuccggcaccagaacagcgaggggacgggccaggccgccgaccugaaguccacccaggccgccaucgaccaggugaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgcggagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgguuccagaucaagggcguggagcugaagagcggguacaaggacuggauccucuggaucagcuucgcgaucuccugcuuccugcugugcgucgugcuccugggcuucaucaugugggccugccagaagggcaacauccgcugcaacaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213667 - RNA, 1718 nt, Artificial Sequence
  mRNA product opt Design1 from Influenza A H3N2 hemagglutinin
gggagaaagcuuaccaugaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagccguccgggcgcaucaccgugagcaccaagcggucccagcaggccgugauccccaacaucggcagccgcccccggauccgcaacaucccgagccggaucuccaucuacuggaccaucgucaagcccggcgacauccugcucaucaacagcacggggaaccugaucgccccgcgcggcuacuucaagauccgguccgggaagagcuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcugaagagcggcuacaaggacuggauccuguggaucuccuucgccaucagcugcuuccuccugugcguggcccugcucggcuucaucaugugggccugccagaaggggaacauccgcugcaacaucugcaucugagg

SEQ ID NO: 213668 - RNA, 2083 nt, Artificial Sequence
  R3238/R3239  mRNA product opt Design2 from Influenza A H3N2 hemagglutinin
ggggcgcugccuacggagguggcagccaucuccuucucggcaucaagcuuaccaugaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagccguccgggcgcaucaccgugagcaccaagcggucccagcaggccgugauccccaacaucggcagccgcccccggauccgcaacaucccgagccggaucuccaucuacuggaccaucgucaagcccggcgacauccugcucaucaacagcacggggaaccugaucgccccgcgcggcuacuucaagauccgguccgggaagagcuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcugaagagcggcuacaaggacuggauccuguggaucuccuucgccaucagcugcuuccuccugugcguggcccugcucggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213669 - RNA, 1893 nt, Artificial Sequence
  R1427 mRNA product opt Design4 from Influenza A H3N2 hemagglutinin
gggagaaagcuuaccaugaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacuccccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcuccugcauccgggggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccggaucaccgugagcacgaagcgcagccagcagaccgugauccccaacaucggcucccggccccgcguccggaacauccccagccgcaucuccaucuacuggaccaucgugaagccgggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcaucccgaacgacaagcccuuccagaacgugaaccgcaucaccuacggcgccugcccccgguacgucaagcagaacacccugaagcuggccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcucuucgagaagaccaagaagcagcugcgggagaacgccgaggacaugggcaacgggugcuucaagaucuaccacaagugcgacaacgccugcaucggcagcauccgcaacgggaccuacgaccacgacgucuaccgggacgaggcgcugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 213670 - RNA, 1918 nt, Artificial Sequence
  mRNA product opt Design1 from Influenza A H3N2 hemagglutinin
gggagaaagcuuaccaugaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacuccccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcuccugcauccgggggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccggaucaccgugagcacgaagcgcagccagcagaccgugauccccaacaucggcucccggccccgcguccggaacauccccagccgcaucuccaucuacuggaccaucgugaagccgggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcaucccgaacgacaagcccuuccagaacgugaaccgcaucaccuacggcgccugcccccgguacgucaagcagaacacccugaagcuggccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcucuucgagaagaccaagaagcagcugcgggagaacgccgaggacaugggcaacgggugcuucaagaucuaccacaagugcgacaacgccugcaucggcagcauccgcaacgggaccuacgaccacgacgucuaccgggacgaggcgcugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213671 - RNA, 2083 nt, Artificial Sequence
  mRNA product opt Design2 from Influenza A H3N2 hemagglutinin
ggggcgcugccuacggagguggcagccaucuccuucucggcaucaagcuuaccaugaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacuccccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcuccugcauccgggggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccggaucaccgugagcacgaagcgcagccagcagaccgugauccccaacaucggcucccggccccgcguccggaacauccccagccgcaucuccaucuacuggaccaucgugaagccgggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcaucccgaacgacaagcccuuccagaacgugaaccgcaucaccuacggcgccugcccccgguacgucaagcagaacacccugaagcuggccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcucuucgagaagaccaagaagcagcugcgggagaacgccgaggacaugggcaacgggugcuucaagaucuaccacaagugcgacaacgccugcaucggcagcauccgcaacgggaccuacgaccacgacgucuaccgggacgaggcgcugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213672 - RNA, 1911 nt, Artificial Sequence
  R887  mRNA product opt Design3 from Influenza A H5N1 hemagglutinin
gggagaaagcuuaccauggagaagaucaugcugcuccuggccaucgugagccuggucaaguccgaccagaucugcaucggcuaccacgccaacaacagcaccgagcagguggacaccaucauggagaagaacgugacggucacccacgcgcaggacauccucgagaagacccacaacgggaagcugugcgaccuggacggcgugaagccccucauccugcgggacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccugcugucccgcaucaaccacuucgagaagauccagaucaucccgaagagcuccuggagcgaccacgaggccuccagcggcguguccagcgccugccccuaccagggccgguccagcuucuuccgcaacgucguguggcucaucaagaaggacaacgcguaccccaccaucaagcgguccuacaacaacacgaaccaggaggaccugcuggugcucugggggauccaccaccccaacgacgccgccgagcagacccgccuguaccagaacccgaccaccuacaucagcgucggcacguccacccugaaccagcggcucgugcccaagaucgccacccgcagcaaggugaacgggcaguccggccggauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgugaagagcaaccgccuggugcuggccacggggcuccggaacuccccgcagggcgagcgccggcgcaagaagcggggccuguucggggcgaucgccggcuucaucgagggcggguggcaggggauggucgacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgcgaguucaacaaccuggagcggcgcaucgagaaccucaacaagaagauggaggacggguuccuggacguguggacguacaacgccgagcugcucgugcugauggagaacgagcggacccuggacuuccacgacagcaacgucaagaaccucuacgacaaggugcgccugcagcugcgggacaacgccaaggagcucggcaacggcugcuucgaguucuaccaccgcugcgacaacgagugcauggaguccguccggaacgggaccuacgacuacccccaguacagcgaggaggcccggcugaagcgcgaggagaucuccggcgugaagcuggagagcaucgggaccuaccagauccucuccaucuacagcacgguggccuccagccuggcgcuggccaucauggucgccggccucucccuguggaugugcagcaacgggagccugcagugccggaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 213673 - RNA, 1924 nt, Artificial Sequence
  R1728 mRNA product opt Design1 from Influenza A H5N1 hemagglutinin
gggagaaagcuuaccauggagaagaucaugcugcuccuggccaucgugagccuggucaaguccgaccagaucugcaucggcuaccacgccaacaacagcaccgagcagguggacaccaucauggagaagaacgugacggucacccacgcgcaggacauccucgagaagacccacaacgggaagcugugcgaccuggacggcgugaagccccucauccugcgggacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccugcugucccgcaucaaccacuucgagaagauccagaucaucccgaagagcuccuggagcgaccacgaggccuccagcggcguguccagcgccugccccuaccagggccgguccagcuucuuccgcaacgucguguggcucaucaagaaggacaacgcguaccccaccaucaagcgguccuacaacaacacgaaccaggaggaccugcuggugcucugggggauccaccaccccaacgacgccgccgagcagacccgccuguaccagaacccgaccaccuacaucagcgucggcacguccacccugaaccagcggcucgugcccaagaucgccacccgcagcaaggugaacgggcaguccggccggauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgugaagagcaaccgccuggugcuggccacggggcuccggaacuccccgcagggcgagcgccggcgcaagaagcggggccuguucggggcgaucgccggcuucaucgagggcggguggcaggggauggucgacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgcgaguucaacaaccuggagcggcgcaucgagaaccucaacaagaagauggaggacggguuccuggacguguggacguacaacgccgagcugcucgugcugauggagaacgagcggacccuggacuuccacgacagcaacgucaagaaccucuacgacaaggugcgccugcagcugcgggacaacgccaaggagcucggcaacggcugcuucgaguucuaccaccgcugcgacaacgagugcauggaguccguccggaacgggaccuacgacuacccccaguacagcgaggaggcccggcugaagcgcgaggagaucuccggcgugaagcuggagagcaucgggaccuaccagauccucuccaucuacagcacgguggccuccagccuggcgcuggccaucauggucgccggccucucccuguggaugugcagcaacgggagccugcagugccggaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213674 - RNA, 2089 nt, Artificial Sequence
  R5076 mRNA product opt Design2 from Influenza A H5N1 hemagglutinin
ggggcgcugccuacggagguggcagccaucuccuucucggcaucaagcuuaccauggagaagaucaugcugcuccuggccaucgugagccuggucaaguccgaccagaucugcaucggcuaccacgccaacaacagcaccgagcagguggacaccaucauggagaagaacgugacggucacccacgcgcaggacauccucgagaagacccacaacgggaagcugugcgaccuggacggcgugaagccccucauccugcgggacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccugcugucccgcaucaaccacuucgagaagauccagaucaucccgaagagcuccuggagcgaccacgaggccuccagcggcguguccagcgccugccccuaccagggccgguccagcuucuuccgcaacgucguguggcucaucaagaaggacaacgcguaccccaccaucaagcgguccuacaacaacacgaaccaggaggaccugcuggugcucugggggauccaccaccccaacgacgccgccgagcagacccgccuguaccagaacccgaccaccuacaucagcgucggcacguccacccugaaccagcggcucgugcccaagaucgccacccgcagcaaggugaacgggcaguccggccggauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgugaagagcaaccgccuggugcuggccacggggcuccggaacuccccgcagggcgagcgccggcgcaagaagcggggccuguucggggcgaucgccggcuucaucgagggcggguggcaggggauggucgacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgcgaguucaacaaccuggagcggcgcaucgagaaccucaacaagaagauggaggacggguuccuggacguguggacguacaacgccgagcugcucgugcugauggagaacgagcggacccuggacuuccacgacagcaacgucaagaaccucuacgacaaggugcgccugcagcugcgggacaacgccaaggagcucggcaacggcugcuucgaguucuaccaccgcugcgacaacgagugcauggaguccguccggaacgggaccuacgacuacccccaguacagcgaggaggcccggcugaagcgcgaggagaucuccggcgugaagcuggagagcaucgggaccuaccagauccucuccaucuacagcacgguggccuccagccuggcgcuggccaucauggucgccggccucucccuguggaugugcagcaacgggagccugcagugccggaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213675 - RNA, 1921 nt, Artificial Sequence
  R5223  mRNA product opt Design1 from Influenza A H6N1 hemagglutinin
gggagaaagcuuaccaugaucgccaucguggucaucgccauccuggcgagcgccggcaaguccgacaagaucugcaucggguaccacgccaacaacagcaccacccagguggacacgcuccuggagaagaacgugaccgucacccacuccguggagcugcucgagaaccagaaggagaagcgcuucugcaagaucaugaacaaggccccgcuggaccugaaggacugcaccaucgagggcuggauccucgggaacccgaagugcgaccugcugcucggcgaccagagcugguccuacaucguggagcggcccaacgcccagaacgggaucugcuaccccggcguccugaacgagcuggaggagcucaaggcguucaucggcagcggggagcgcguggagcgguucgagauguuccccaaguccacgugggccggcguggacaccagccgcggggucaccaacgccugcccguccuacaccaucgacagcuccuucuaccggaaccugguguggaucgugaagacggacagcgccaccuaccccgucaucaagggcaccuacaacaacaccgggacgcagcccauccuguacuucuggggcgugcaccacccccucgacaccaccgugcaggacaaccuguacggcuccggggacaaguacguccgcaugggcaccgagagcaugaacuucgcgaaguccccggagaucgccgcccggcccgccgugaacgggcagcgcagccggaucgacuacuacugguccgugcugcgccccggcgagacgcucaacgucgagagcaacggcaaccugaucgcccccugguacgcguacaaguucguguccaccaacaagaagggggccguguucaagagcgaccugccgaucgagaacugcgacgccaccugccagaccaucacgggcguccuccggaccaacaagaccuuccagaacgugagcccccuguggaucggggagugccccaaguacgugaaguccgagagccugcgccucgccaccggccugcggaacgucccccagaucgccacgcgcgggaucuucggcgcgaucgccggcuucaucgagggcggguggaccgggaugaucgacggcugguacggguaccaccacgagaacucccagggcagcggcuacgccgccgaccgggaguccacccagaaggccaucgacgggaucaccaacaaggugaacagcaucaucaacaagaugaacacgcaguucgaggcggucgaccacgaguucuccaaccuggagcgccggaucggcaaccucaacaagcgcauggaggacggguuccuggacguguggaccuacaacgccgagcugcucgugcugcuggagaacgagcggacccucgaccugcacgacgccaacgucaagaaccuguacgagaaggugaagagccagcuccgcgacaacgccaacgaccugggcaacgggugcuucgaguucuggcacaagugcgacaacgagugcauggaguccgugaagaacggcaccuacgacuacccgaaguaccagaaggagagcaagcugaaccggcagggcaucgaguccgucaagcucgagaaccuggggguguaccagauccuggccaucuacagcacgguguccagcucccucguccuggugggccugaucauggcgaucgggcucuggaugugcagcaacggcuccaugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213676 - RNA, 2086 nt, Artificial Sequence
  R3417/R3418 mRNA product opt Design2 from Influenza A H6N1 hemagglutinin
ggggcgcugccuacggagguggcagccaucuccuucucggcaucaagcuuaccaugaucgccaucguggucaucgccauccuggcgagcgccggcaaguccgacaagaucugcaucggguaccacgccaacaacagcaccacccagguggacacgcuccuggagaagaacgugaccgucacccacuccguggagcugcucgagaaccagaaggagaagcgcuucugcaagaucaugaacaaggccccgcuggaccugaaggacugcaccaucgagggcuggauccucgggaacccgaagugcgaccugcugcucggcgaccagagcugguccuacaucguggagcggcccaacgcccagaacgggaucugcuaccccggcguccugaacgagcuggaggagcucaaggcguucaucggcagcggggagcgcguggagcgguucgagauguuccccaaguccacgugggccggcguggacaccagccgcggggucaccaacgccugcccguccuacaccaucgacagcuccuucuaccggaaccugguguggaucgugaagacggacagcgccaccuaccccgucaucaagggcaccuacaacaacaccgggacgcagcccauccuguacuucuggggcgugcaccacccccucgacaccaccgugcaggacaaccuguacggcuccggggacaaguacguccgcaugggcaccgagagcaugaacuucgcgaaguccccggagaucgccgcccggcccgccgugaacgggcagcgcagccggaucgacuacuacugguccgugcugcgccccggcgagacgcucaacgucgagagcaacggcaaccugaucgcccccugguacgcguacaaguucguguccaccaacaagaagggggccguguucaagagcgaccugccgaucgagaacugcgacgccaccugccagaccaucacgggcguccuccggaccaacaagaccuuccagaacgugagcccccuguggaucggggagugccccaaguacgugaaguccgagagccugcgccucgccaccggccugcggaacgucccccagaucgccacgcgcgggaucuucggcgcgaucgccggcuucaucgagggcggguggaccgggaugaucgacggcugguacggguaccaccacgagaacucccagggcagcggcuacgccgccgaccgggaguccacccagaaggccaucgacgggaucaccaacaaggugaacagcaucaucaacaagaugaacacgcaguucgaggcggucgaccacgaguucuccaaccuggagcgccggaucggcaaccucaacaagcgcauggaggacggguuccuggacguguggaccuacaacgccgagcugcucgugcugcuggagaacgagcggacccucgaccugcacgacgccaacgucaagaaccuguacgagaaggugaagagccagcuccgcgacaacgccaacgaccugggcaacgggugcuucgaguucuggcacaagugcgacaacgagugcauggaguccgugaagaacggcaccuacgacuacccgaaguaccagaaggagagcaagcugaaccggcagggcaucgaguccgucaagcucgagaaccuggggguguaccagauccuggccaucuacagcacgguguccagcucccucguccuggugggccugaucauggcgaucgggcucuggaugugcagcaacggcuccaugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213677 - RNA, 1896 nt, Artificial Sequence
  R1052  mRNA product opt Design3 from Influenza A H7N7 hemagglutinin
gggagaaagcuuaccaugaacacccagauccugguguucgcccucgucgccgugauccacaccaacgcggacaagaucugccugggccaccacgccgugagcaacgggacgaaggucaacacccugaccgagcggggcguggagguggucaacgccaccgagacgguggagcgcaccaacauccccaagaucugcuccaaggggaagcggaccguggaccucggccagugcgggcugcugggcaccaucacgggccagccgcagugcgaccaguuccucgaguucagcgccgaccugaucaucgagcgccgggacgggaacgacgucugcuaccccggcaaguucgugaacggggaggcccugcgccagauccuccggaaguccggcgggaucaacaaggagaccaugggcuucaccuacagcggcauccgcaccaacgggacgaccuccgcgugccggcgcagcggcuccagcuucuacgccgagaugaaguggcugcuguccgacaccgacaacgccgccuucccccagaugaccaagagcuacaagaacacgcggcgcgagcccgcgcucaucgugugggggauccaccacuccggcagcaccaccgagcagaccaagcuguacggcuccgggaacaagcuggucacggugggcagcuccaaguaccagcagagcuucgugccgucccccgagacccggccccaggucaacgggcagagcggccgcaucgacuuccacuggcucauccuggacuccaacgacaccgugaccuucagcuucaacggggccuucaucgcccccgaccgggccagcuuccugaagggcaaguccaugggcauccagagcgacgugcaggucgacgccaacugcgagggggagugcuaccacuccggcgggacgaucaccagcucccucccguuccagaacaucaacagccgcgcggugggcaagugcccccgguacgugaagcaggagucccugcugcucgccaccgggaugaagaacguccccgagcugagcaagaagcgccggaagcgcggccuguucggcgccaucgccggguucaucgagaacggcugggaggggcucguggacggcugguacggguuccggcaccagaacgcccagggcgagggcaccgcggccgacuacaaguccacgcagagcgccaucgaccagaucaccgggaagcugaaccgccugaucgagaagaccaaccagcaguucgagcucaucgacaacgaguucaccgagguggagaagcagaucggcaacgucaucaacuggacgcgggacuccaucaccgagguguggagcuacaacgccgagcugcuggucgccauggagaaccagcacaccaucgaccucgcggacuccgagaugaacaagcuguacgagcgggugcgcaagcagcugcgggagaacgccgaggaggacgggaccggcugcuucgagaucuuccacaagugcgacgacgacugcauggccagcauccgcaacaacacguacgaccacuccaaguaccgggaggaggccaugcagaaccgcauccagaucgaccccgugaagcucagcggcggguacaaggacgucauccugugguucuccuucggcgccagcugcuuccugcuccuggcgaucgccauggggcugguguucaucugcgugaagaacggcaacaugcggugcaccaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 213678 - RNA, 1909 nt, Artificial Sequence
  R2191 mRNA product opt Design1 from Influenza A H7N7 hemagglutinin
gggagaaagcuuaccaugaacacccagauccugguguucgcccucgucgccgugauccacaccaacgcggacaagaucugccugggccaccacgccgugagcaacgggacgaaggucaacacccugaccgagcggggcguggagguggucaacgccaccgagacgguggagcgcaccaacauccccaagaucugcuccaaggggaagcggaccguggaccucggccagugcgggcugcugggcaccaucacgggccagccgcagugcgaccaguuccucgaguucagcgccgaccugaucaucgagcgccgggacgggaacgacgucugcuaccccggcaaguucgugaacggggaggcccugcgccagauccuccggaaguccggcgggaucaacaaggagaccaugggcuucaccuacagcggcauccgcaccaacgggacgaccuccgcgugccggcgcagcggcuccagcuucuacgccgagaugaaguggcugcuguccgacaccgacaacgccgccuucccccagaugaccaagagcuacaagaacacgcggcgcgagcccgcgcucaucgugugggggauccaccacuccggcagcaccaccgagcagaccaagcuguacggcuccgggaacaagcuggucacggugggcagcuccaaguaccagcagagcuucgugccgucccccgagacccggccccaggucaacgggcagagcggccgcaucgacuuccacuggcucauccuggacuccaacgacaccgugaccuucagcuucaacggggccuucaucgcccccgaccgggccagcuuccugaagggcaaguccaugggcauccagagcgacgugcaggucgacgccaacugcgagggggagugcuaccacuccggcgggacgaucaccagcucccucccguuccagaacaucaacagccgcgcggugggcaagugcccccgguacgugaagcaggagucccugcugcucgccaccgggaugaagaacguccccgagcugagcaagaagcgccggaagcgcggccuguucggcgccaucgccggguucaucgagaacggcugggaggggcucguggacggcugguacggguuccggcaccagaacgcccagggcgagggcaccgcggccgacuacaaguccacgcagagcgccaucgaccagaucaccgggaagcugaaccgccugaucgagaagaccaaccagcaguucgagcucaucgacaacgaguucaccgagguggagaagcagaucggcaacgucaucaacuggacgcgggacuccaucaccgagguguggagcuacaacgccgagcugcuggucgccauggagaaccagcacaccaucgaccucgcggacuccgagaugaacaagcuguacgagcgggugcgcaagcagcugcgggagaacgccgaggaggacgggaccggcugcuucgagaucuuccacaagugcgacgacgacugcauggccagcauccgcaacaacacguacgaccacuccaaguaccgggaggaggccaugcagaaccgcauccagaucgaccccgugaagcucagcggcggguacaaggacgucauccugugguucuccuucggcgccagcugcuuccugcuccuggcgaucgccauggggcugguguucaucugcgugaagaacggcaacaugcggugcaccaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213679 - RNA, 2074 nt, Artificial Sequence
  mRNA product opt Design2 from Influenza A H7N7 hemagglutinin
ggggcgcugccuacggagguggcagccaucuccuucucggcaucaagcuuaccaugaacacccagauccugguguucgcccucgucgccgugauccacaccaacgcggacaagaucugccugggccaccacgccgugagcaacgggacgaaggucaacacccugaccgagcggggcguggagguggucaacgccaccgagacgguggagcgcaccaacauccccaagaucugcuccaaggggaagcggaccguggaccucggccagugcgggcugcugggcaccaucacgggccagccgcagugcgaccaguuccucgaguucagcgccgaccugaucaucgagcgccgggacgggaacgacgucugcuaccccggcaaguucgugaacggggaggcccugcgccagauccuccggaaguccggcgggaucaacaaggagaccaugggcuucaccuacagcggcauccgcaccaacgggacgaccuccgcgugccggcgcagcggcuccagcuucuacgccgagaugaaguggcugcuguccgacaccgacaacgccgccuucccccagaugaccaagagcuacaagaacacgcggcgcgagcccgcgcucaucgugugggggauccaccacuccggcagcaccaccgagcagaccaagcuguacggcuccgggaacaagcuggucacggugggcagcuccaaguaccagcagagcuucgugccgucccccgagacccggccccaggucaacgggcagagcggccgcaucgacuuccacuggcucauccuggacuccaacgacaccgugaccuucagcuucaacggggccuucaucgcccccgaccgggccagcuuccugaagggcaaguccaugggcauccagagcgacgugcaggucgacgccaacugcgagggggagugcuaccacuccggcgggacgaucaccagcucccucccguuccagaacaucaacagccgcgcggugggcaagugcccccgguacgugaagcaggagucccugcugcucgccaccgggaugaagaacguccccgagcugagcaagaagcgccggaagcgcggccuguucggcgccaucgccggguucaucgagaacggcugggaggggcucguggacggcugguacggguuccggcaccagaacgcccagggcgagggcaccgcggccgacuacaaguccacgcagagcgccaucgaccagaucaccgggaagcugaaccgccugaucgagaagaccaaccagcaguucgagcucaucgacaacgaguucaccgagguggagaagcagaucggcaacgucaucaacuggacgcgggacuccaucaccgagguguggagcuacaacgccgagcugcuggucgccauggagaaccagcacaccaucgaccucgcggacuccgagaugaacaagcuguacgagcgggugcgcaagcagcugcgggagaacgccgaggaggacgggaccggcugcuucgagaucuuccacaagugcgacgacgacugcauggccagcauccgcaacaacacguacgaccacuccaaguaccgggaggaggccaugcagaaccgcauccagaucgaccccgugaagcucagcggcggguacaaggacgucauccugugguucuccuucggcgccagcugcuuccugcuccuggcgaucgccauggggcugguguucaucugcgugaagaacggcaacaugcggugcaccaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213680 - RNA, 1975 nt, Artificial Sequence
  R2361/R2493 mRNA product opt Design1 from Influenza B hemagglutinin
gggagaaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213681 - RNA, 2140 nt, Artificial Sequence
  R2565/R2648 mRNA product opt Design2 from Influenza B hemagglutinin
ggggcgcugccuacggagguggcagccaucuccuucucggcaucaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213682 - RNA, 1984 nt, Artificial Sequence
  mRNA product opt Design1 from Influenza B hemagglutinin
gggagaaagcuuaccaugaagugggugaccuucaucagccugcucuuccuguucuccagcgccuacuccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213683 - RNA, 2149 nt, Artificial Sequence
  mRNA product opt Design2 from Influenza B hemagglutinin
ggggcgcugccuacggagguggcagccaucuccuucucggcaucaagcuuaccaugaagugggugaccuucaucagccugcucuuccuguucuccagcgccuacuccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213684 - RNA, 1984 nt, Artificial Sequence
  mRNA product opt Design1 from Influenza B hemagglutinin
gggagaaagcuuaccauggacuggaccuggauccuguuccucguggccgccgcgacccgcguccacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213685 - RNA, 2149 nt, Artificial Sequence
  mRNA product opt Design2 from Influenza B hemagglutinin
ggggcgcugccuacggagguggcagccaucuccuucucggcaucaagcuuaccauggacuggaccuggauccuguuccucguggccgccgcgacccgcguccacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213686 - RNA, 2002 nt, Artificial Sequence
  mRNA product opt Design1 from Influenza B hemagglutinin
gggagaaagcuuaccaugcccaugggcagccugcagccgcucgccacccuguaccugcucgggaugcugguggccuccugccugggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213687 - RNA, 2167 nt, Artificial Sequence
  mRNA product opt Design2 from Influenza B hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213688 - RNA, 2002 nt, Artificial Sequence
  mRNA product opt Design1 from Influenza B hemagglutinin
gggagaaagcuuaccauggccgugauggccccgcggacccugguccuccugcugagcggcgcgcucgcccugacccagacgugggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213689 - RNA, 2167 nt, Artificial Sequence
  mRNA product opt Design2 from Influenza B hemagglutinin
ggggcgcugccuacggagguggcagccaucuccuucucggcaucaagcuuaccauggccgugauggccccgcggacccugguccuccugcugagcggcgcgcucgcccugacccagacgugggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213690 - RNA, 1972 nt, Artificial Sequence
  R4904 mRNA product opt Design1 from Influenza B hemagglutinin
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213691 - RNA, 2137 nt, Artificial Sequence
  mRNA product opt Design2 from Influenza B hemagglutinin
ggggcgcugccuacggagguggcagccaucuccuucucggcaucaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213692 - RNA, 1981 nt, Artificial Sequence
  mRNA product opt Design1 from Influenza B hemagglutinin
gggagaaagcuuaccaugaagugggugaccuucaucagccugcucuuccuguucuccagcgccuacuccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213693 - RNA, 2146 nt, Artificial Sequence
  mRNA product opt Design2 from Influenza B hemagglutinin
ggggcgcugccuacggagguggcagccaucuccuucucggcaucaagcuuaccaugaagugggugaccuucaucagccugcucuuccuguucuccagcgccuacuccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213694 - RNA, 1981 nt, Artificial Sequence
  mRNA product opt Design1 from Influenza B hemagglutinin
gggagaaagcuuaccauggacuggaccuggauccuguuccucguggccgccgcgacccgcguccacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213695 - RNA, 2146 nt, Artificial Sequence
  mRNA product opt Design2 from Influenza B hemagglutinin
ggggcgcugccuacggagguggcagccaucuccuucucggcaucaagcuuaccauggacuggaccuggauccuguuccucguggccgccgcgacccgcguccacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213696 - RNA, 1999 nt, Artificial Sequence
  mRNA product opt Design1 from Influenza B hemagglutinin
gggagaaagcuuaccaugcccaugggcagccugcagccgcucgccacccuguaccugcucgggaugcugguggccuccugccugggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213697 - RNA, 2164 nt, Artificial Sequence
  mRNA product opt Design2 from Influenza B hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213698 - RNA, 1999 nt, Artificial Sequence
  mRNA product opt Design1 from Influenza B hemagglutinin
gggagaaagcuuaccauggccgugauggccccgcggacccugguccuccugcugagcggcgcgcucgcccugacccagacgugggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213699 - RNA, 2164 nt, Artificial Sequence
  mRNA product opt Design2 from Influenza B hemagglutinin
ggggcgcugccuacggagguggcagccaucuccuucucggcaucaagcuuaccauggccgugauggccccgcggacccugguccuccugcugagcggcgcgcucgcccugacccagacgugggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213700 - RNA, 1972 nt, Artificial Sequence
  R4905 mRNA product opt Design1 from Influenza B hemagglutinin
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213701 - RNA, 2137 nt, Artificial Sequence
  mRNA product opt Design2 from Influenza B hemagglutinin
ggggcgcugccuacggagguggcagccaucuccuucucggcaucaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213702 - RNA, 1972 nt, Artificial Sequence
  mRNA product opt Design1 from Influenza B hemagglutinin
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccaccaagagccacuucgccaaccugaaggggacgcagacccggggcaagcucugccccaacugcuucaacugcaccgaccuggacguggcccuggggcgccccaagugcaugggcaacaccccguccgccaaggugagcauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgcccggcgggcccuacaaggugggcaccagcggguccugccccaacgucgccaacggcaacggcuucuucaacaccauggccugggugauccccaaggacaacaacaagaccgccaucaaccccgugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacuaccugagcgagcucgaggucaagaaccugcagcggcuguccggcgcgaugaacgagcuccacgacgagauccuggagcuggacgagaagguggacgaccuccgcgccgacaccaucagcucccagaucgagcuggccgugcugcucagcaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacggccuggacaaccacacgauccugcuguacuacagcaccgccgccuccagccucgccgugacccugaugaucgccaucuucaucguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213703 - RNA, 2137 nt, Artificial Sequence
  R4643/R4644 mRNA product opt Design2 from Influenza B hemagglutinin
ggggcgcugccuacggagguggcagccaucuccuucucggcaucaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccaccaagagccacuucgccaaccugaaggggacgcagacccggggcaagcucugccccaacugcuucaacugcaccgaccuggacguggcccuggggcgccccaagugcaugggcaacaccccguccgccaaggugagcauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgcccggcgggcccuacaaggugggcaccagcggguccugccccaacgucgccaacggcaacggcuucuucaacaccauggccugggugauccccaaggacaacaacaagaccgccaucaaccccgugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacuaccugagcgagcucgaggucaagaaccugcagcggcuguccggcgcgaugaacgagcuccacgacgagauccuggagcuggacgagaagguggacgaccuccgcgccgacaccaucagcucccagaucgagcuggccgugcugcucagcaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacggccuggacaaccacacgauccugcuguacuacagcaccgccgccuccagccucgccgugacccugaugaucgccaucuucaucguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213704 - RNA, 1972 nt, Artificial Sequence
  mRNA product opt Design1 from Influenza B hemagglutinin
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccacccggagccacuucgccaaccugaaggggacgcagacccggggcaagcucugccccaacugcuucaacugcaccgaccuggacguggcccuggggcgccccaagugcaugggcaacaucccguccgccaaggugagcauccuccacgaggucaagcccgugacguccggcugcuuccccaucaugcacgaccggaccaagauccgccagcugcccaaccugcuccggggguacgagaacauccgccugagcaccuccaacgugaucaacgccgagacggcgcccggcgggcccuacaaggugggcaccagcggguccugccccaacgucgccaaccgcaacggcuucuucaacaccauggccugggugauccccaaggacaacaacaagaccgccaucaaccccgugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacagccugagcgagcucgaggucaagaaccugcagcggcuguccggcgcgaugaacggccuccacgacgagauccuggagcuggacgagaagguggacgaccuccgcgccgacaccaucagcucccagaucgagcuggccgugcugcucagcaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacgaccuggacaaccacacgauccugcuguacuacagcaccgccgccuccagccucgccgugacccugaugaucgccaucuucaucguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213705 - RNA, 2137 nt, Artificial Sequence
  R4645/R4646 mRNA product opt Design2 from Influenza B hemagglutinin
ggggcgcugccuacggagguggcagccaucuccuucucggcaucaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccacccggagccacuucgccaaccugaaggggacgcagacccggggcaagcucugccccaacugcuucaacugcaccgaccuggacguggcccuggggcgccccaagugcaugggcaacaucccguccgccaaggugagcauccuccacgaggucaagcccgugacguccggcugcuuccccaucaugcacgaccggaccaagauccgccagcugcccaaccugcuccggggguacgagaacauccgccugagcaccuccaacgugaucaacgccgagacggcgcccggcgggcccuacaaggugggcaccagcggguccugccccaacgucgccaaccgcaacggcuucuucaacaccauggccugggugauccccaaggacaacaacaagaccgccaucaaccccgugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacagccugagcgagcucgaggucaagaaccugcagcggcuguccggcgcgaugaacggccuccacgacgagauccuggagcuggacgagaagguggacgaccuccgcgccgacaccaucagcucccagaucgagcuggccgugcugcucagcaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacgaccuggacaaccacacgauccugcuguacuacagcaccgccgccuccagccucgccgugacccugaugaucgccaucuucaucguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213706 - RNA, 1972 nt, Artificial Sequence
  mRNA product opt Design1 from Influenza B hemagglutinin
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacgacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagccguacuacaccggggagcacgccaaggccaucggcaacugccccaucugggucaagaccccgcugaagcuggcgaacggcaccaaguaccgcccgcccgccaagcuccugaaggagcggggguucuucggcgccaucgccggguuccuggagggcgggugggagggcaugaucgccggcuggcacggguacacgagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccugcuggcccucgagcgcaagcugaagaagaugcuggggccguccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccugaacgacgacggccucgacaaccacacgauccugcuguacuacuccaccgccgccagcucccucgccgugacccugaugcuggccaucuucaucgucuacauggugagccgcgacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213707 - RNA, 2137 nt, Artificial Sequence
  R3236/R3237 mRNA product opt Design2 from Influenza B hemagglutinin
ggggcgcugccuacggagguggcagccaucuccuucucggcaucaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacgacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagccguacuacaccggggagcacgccaaggccaucggcaacugccccaucugggucaagaccccgcugaagcuggcgaacggcaccaaguaccgcccgcccgccaagcuccugaaggagcggggguucuucggcgccaucgccggguuccuggagggcgggugggagggcaugaucgccggcuggcacggguacacgagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccugcuggcccucgagcgcaagcugaagaagaugcuggggccguccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccugaacgacgacggccucgacaaccacacgauccugcuguacuacuccaccgccgccagcucccucgccgugacccugaugcuggccaucuucaucgucuacauggugagccgcgacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213708 - RNA, 1569 nt, Artificial Sequence
  R904/R997 mRNA product opt Design3 from Influenza A H1N1 neuraminidase
gggagaaagcuuaccaugaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccggggcugggccaucuacagcaaggacaacuccauccgcaucggcagcaagggggacgucuucgugauccgggagcccuucaucuccugcagccaccuggagugccgcaccuucuuccucacccagggcgcccugcugaacgacaagcacuccagcgggacggugaaggaccggucccccuaccgcgcgcucaugagcugccccgucggcgaggccccgucccccuacaacagccgguucgagagcguggccugguccgccagcgccugccacgacgggaugggcuggcugaccaucggcaucuccgggcccgacaacggcgcgguggccguccugaaguacaacgggaucaucaccgagaccaucaagagcuggcgcaagaagauccuccggacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgcgacaacuggcacggcagcaaccggcccuggguguccuucgaccagaaccucgacuaccagaucggguacaucugcagcggcgucuucggcgacaacccccgcccggaggacgggaccggcuccugcgggcccguguacguggacggcgccaacggggucaagggcuucagcuaccgguacggcaacgggguguggaucggccgcaccaagucccacagcucccggcacggguucgagaugaucugggaccccaacggcuggaccgagacggacagcaaguucagcgugcgccaggacgucguggccaugaccgacugguccggguacagcggcuccuucgugcagcaccccgagcugaccggccuggacugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaagugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 213709 - RNA, 1582 nt, Artificial Sequence
  mRNA product opt Design1 from Influenza A H1N1 neuraminidase
gggagaaagcuuaccaugaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccggggcugggccaucuacagcaaggacaacuccauccgcaucggcagcaagggggacgucuucgugauccgggagcccuucaucuccugcagccaccuggagugccgcaccuucuuccucacccagggcgcccugcugaacgacaagcacuccagcgggacggugaaggaccggucccccuaccgcgcgcucaugagcugccccgucggcgaggccccgucccccuacaacagccgguucgagagcguggccugguccgccagcgccugccacgacgggaugggcuggcugaccaucggcaucuccgggcccgacaacggcgcgguggccguccugaaguacaacgggaucaucaccgagaccaucaagagcuggcgcaagaagauccuccggacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgcgacaacuggcacggcagcaaccggcccuggguguccuucgaccagaaccucgacuaccagaucggguacaucugcagcggcgucuucggcgacaacccccgcccggaggacgggaccggcuccugcgggcccguguacguggacggcgccaacggggucaagggcuucagcuaccgguacggcaacgggguguggaucggccgcaccaagucccacagcucccggcacggguucgagaugaucugggaccccaacggcuggaccgagacggacagcaaguucagcgugcgccaggacgucguggccaugaccgacugguccggguacagcggcuccuucgugcagcaccccgagcugaccggccuggacugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaagugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213710 - RNA, 1747 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccggggcugggccaucuacagcaaggacaacuccauccgcaucggcagcaagggggacgucuucgugauccgggagcccuucaucuccugcagccaccuggagugccgcaccuucuuccucacccagggcgcccugcugaacgacaagcacuccagcgggacggugaaggaccggucccccuaccgcgcgcucaugagcugccccgucggcgaggccccgucccccuacaacagccgguucgagagcguggccugguccgccagcgccugccacgacgggaugggcuggcugaccaucggcaucuccgggcccgacaacggcgcgguggccguccugaaguacaacgggaucaucaccgagaccaucaagagcuggcgcaagaagauccuccggacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgcgacaacuggcacggcagcaaccggcccuggguguccuucgaccagaaccucgacuaccagaucggguacaucugcagcggcgucuucggcgacaacccccgcccggaggacgggaccggcuccugcgggcccguguacguggacggcgccaacggggucaagggcuucagcuaccgguacggcaacgggguguggaucggccgcaccaagucccacagcucccggcacggguucgagaugaucugggaccccaacggcuggaccgagacggacagcaaguucagcgugcgccaggacgucguggccaugaccgacugguccggguacagcggcuccuucgugcagcaccccgagcugaccggccuggacugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaagugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213711 - RNA, 1225 nt, Artificial Sequence
  R1592/R1594 mRNA product opt Design1 encoding HA of Influenza A H1N1pdm09 HA A/California/7/2009
gggagaaagcucuagcaccauggccgugauggccccgcggacccugguccuccugcugagcggcgcgcucgcccugacccagacgugggccggguccaagcuuauggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaggacuacaaggacgacgacgacaagacuaguauccccaucgugggcaucaucgccgggcugguccucuucggcgccgugaucaccggggcgguggucgccgccgugauguggcggcgcaagagcuccgaccggaagggcgggagcuacucccaggccgccagcuccgacagcgcgcagggcuccgacgugagccugaccgccugagucuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213712 - RNA, 1387 nt, Artificial Sequence
  mRNA product opt Design2 encoding HA of Influenza A H1N1pdm09 HA A/California/7/2009
ggggcgcugccuacggagguggcagccaucuccuucucggcaucaagcuuaccauggccgugauggccccgcggacccugguccuccugcugagcggcgcgcucgcccugacccagacgugggccggguccaagcuuauggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaggacuacaaggacgacgacgacaagacuaguauccccaucgugggcaucaucgccgggcugguccucuucggcgccgugaucaccggggcgguggucgccgccgugauguggcggcgcaagagcuccgaccggaagggcgggagcuacucccaggccgccagcuccgacagcgcgcagggcuccgacgugagccugaccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213713 - protein, 334 aa, Artificial Sequence
  derived and/or mutant sequence encoding HA of Influenza A H1N1pdm09 HA A/California/7/2009
MAVMAPRTLVLLLSGALALTQTWAGSKLMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKDYKDDDDKTSIPIVGIIAGLVLFGAVITGAVVAAVMWRRKSSDRKGGSYSQAASSDSAQGSDVSLTA

SEQ ID NO: 213714 - RNA, 1870 nt, Artificial Sequence
  R1265/R2569 mRNA product opt Design1 from luciferase
gggagaaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213715 - RNA, 2035 nt, Artificial Sequence
  R2244/R2667 mRNA product opt Design2 from luciferase
ggggcgcugccuacggagguggcagccaucuccuucucggcaucaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213716 - DNA, 42 bp, Artificial Sequence
  5-UTR of human ribosomal protein Large 32 lacking the 5 terminal oligopyrimidine tract
ggcgctgcctacggaggtggcagccatctccttctcggcatc

SEQ ID NO: 213717 - RNA, 42 nt, Artificial Sequence
  5-UTR of human ribosomal protein Large 32 lacking the 5 terminal oligopyrimidine tract mRNA
ggcgcugccuacggagguggcagccaucuccuucucggcauc

SEQ ID NO: 213718 - DNA, 75 bp, Artificial Sequence
  5-UTR of human mitochondrial ATP synthase subunit alpha lacking the 5 terminal oligopyrimidine tract
gcggctcggccattttgtcccagtcagtccggaggctgcggctgcagaagtaccgcctgcggagtaactgcaaag

SEQ ID NO: 213719 - RNA, 75 nt, Artificial Sequence
  5-UTR of human mitochondrial ATP synthase subunit alpha lacking the 5 terminal oligopyrimidine tract mRNA
gcggcucggccauuuugucccagucaguccggaggcugcggcugcagaaguaccgccugcggaguaacugcaaag

SEQ ID NO: 213720 - DNA, 110 bp, Artificial Sequence
  3-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 213721 - RNA, 110 nt, Artificial Sequence
  3-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 213722 - DNA, 108 bp, Artificial Sequence
  3-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 213723 - RNA, 108 nt, Artificial Sequence
  3-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 213724 - DNA, 132 bp, Artificial Sequence
  3-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 213725 - RNA, 132 nt, Artificial Sequence
  3-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 213726 - DNA, 44 bp, Artificial Sequence
  Center, alpha-complex-binding portion of the 3UTR of an alpha-globin gene (muag)
gcccgatgggcctcccaacgggccctcctcccctccttgcaccg

SEQ ID NO: 213727 - RNA, 44 nt, Artificial Sequence
  Center, alpha-complex-binding portion of the 3UTR of an alpha-globin gene (muag) mRNA
gcccgaugggccucccaacgggcccuccuccccuccuugcaccg

SEQ ID NO: 213728 - DNA, 186 bp, Artificial Sequence
  3-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 213729 - RNA, 186 nt, Artificial Sequence
  3-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 213730 - DNA, 186 bp, Artificial Sequence
  3-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 213731 - RNA, 186 nt, Artificial Sequence
  3-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 213732 - DNA, 187 bp, Artificial Sequence
  3-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 213733 - RNA, 187 nt, Artificial Sequence
  3-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 213734 - DNA, 24 bp, Artificial Sequence
  histone stem-loop sequence
caaaggctcttttcagagccacca

SEQ ID NO: 213735 - RNA, 24 nt, Artificial Sequence
  histone stem-loop sequence mRNA
caaaggcucuuuucagagccacca

SEQ ID NO: 213736 - DNA, 13 bp, Artificial Sequence
  Kozak
gccgccaccatgg

SEQ ID NO: 213737 - RNA, 13 nt, Artificial Sequence
  Kozak mRNA
gccgccaccaugg

SEQ ID NO: 213738 - protein, 449 aa, Artificial Sequence; identical to SEQ ID NO: 26371
  derived and/or mutant sequence from Influenza A H5N1 neuraminidase

SEQ ID NO: 213739 - protein, 449 aa, Artificial Sequence
  derived and/or mutant sequence from Influenza A H5N1 neuraminidase
MNPNQKIITIGSICMVTGIVSLMLQIGNMISIWVSHSIHTGNQHQSEPISNTNLLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAGGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 213740 - RNA, 1350 nt, Artificial Sequence; identical to SEQ ID NO: 56875
  derived and/or mutant sequence from Influenza A H5N1 neuraminidase

SEQ ID NO: 213741 - RNA, 1350 nt, Artificial Sequence
  derived and/or mutant sequence from Influenza A H5N1 neuraminidase
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuugcuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcgguggcuguauugaaauacaauggcauaauaacagacacuaucaagaguuggaggaacaacauacugagaacucaagagucugaaugugcauguguaaaugguucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcaugguucaaaucggccauggguaucuuucaaucaaaauuuggaguaucaaauaggauauauaugcaguggaguuuucggagacaauccacgccccaaugauggaacagguaguugugguccgguguccucuaacggggcaggugggguaaaaggguuuucauuuaaauacggcaauggugucuggaucgggagaaccaaaagcacuaauuccaggagcggcuucgaaaugauuugggauccaaauggguggacugaaacggacagcagcuuuucagugaaacaagauaucguagcaauaacugauuggucaggauauagcgggaguuuuguccagcauccagagcugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 213742 - RNA, 1410 nt, Artificial Sequence
  derived and/or modified sequence opt from Influenza A H1N1 hemagglutinin
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcggaucggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 213743 - RNA, 1410 nt, Artificial Sequence
  derived and/or modified sequence opt from Influenza A H1N1 hemagglutinin
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgggugggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucauccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 213744 - RNA, 1410 nt, Artificial Sequence
  derived and/or modified sequence opt from Influenza A H3N2 hemagglutinin
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgucugcaucaccggggacgacaagaacgcgaccgccagcuucaucuacaacggccggcucguggacuccguggucagcugguccaaggacauccugcgcacccaggagagcgagugcaucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgcccgaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaacccgaagagcaagcugcagaccaaccgccaggucaucguggaccggggcgaccgcuccggguacagcgggaucuucuccguggagggcaagagcugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucuga

SEQ ID NO: 213745 - RNA, 1350 nt, Artificial Sequence
  derived and/or modified sequence opt from Influenza A H5N1 hemagglutinin
augaaccccaaccagaagaucaucaccaucggcagcaucugcauggugaucgggaucgucucccugaugcuccagaucggcaacaugaucagcaucugggugucccacagcauccagaccgggaaccagcggcaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccaucaaggaccgcagcccccaccggacccugauguccugcccggugggggaggcccccagccccuacaacucccgcuucgagagcguggcguggagcgccuccgccugccacgacggcaccagcuggcucacgaucgggaucuccggccccgacaacggcgccgucgcggugcugaaguacaacgggaucaucaccgacaccaucaagagcuggcggaacaacauccugcgcacccaggaguccgagugcgccugcgugaacggcagcugcuucacggucaugaccgacgggccguccagcggccaggccuccuacaagaucuucaagauggagaagggcaagguggugaagagcgucgagcucgacgcccccaacuaccacuacgaggagugcuccugcuaccccgacgccggggagaucaccugcgugugccgggacaacuggcacggcagcaaccgccccuggguguccuucaaccagaaccuggaguaccagaucggguacaucugcagcggcgucuucggggacaacccgcggcccaacgacggcaccggcuccugcgggcccgugagccccaacggcgcguacggggugaagggcuucuccuucaaguacgggaacggcgucuggaucggccgcacgaagagcaccaacucccggagcggguucgagaugaucugggacccgaacggcuggaccgggaccgacagcuccuucagcgugaagcaggacaucguggccaucacggacugguccggcuacagcggguccuucguccagcaccccgagcugaccggccucgacugcauccgccccugcuucuggguggagcugauccggggccgccccaaggagagcaccaucuggaccuccgggagcuccaucagcuucugcggcgucaacuccgacacggugagcugguccuggccggacggggccgagcugcccuucaccaucgacaaguga

SEQ ID NO: 213746 - RNA, 1350 nt, Artificial Sequence
  derived and/or modified sequence opt from Influenza A H5N1 hemagglutinin
augaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaaccugcugaccgagaaggccguggccuccgucaagcucgcgggcaacagcucccugugccccaucaacgggugggccguguacagcaaggacaacuccauccggaucggcagcaagggcgacguguucgucauccgcgagcccuucaucuccugcagccaccuggagugccggaccuucuuccucacgcagggggcccugcugaacgacaagcacuccaacggcaccgugaaggaccgcagcccccaccggacccucauguccugcccggugggggaggcccccagccccuacaacucccgcuucgagagcgucgccuggagcgcguccgccugccacgacggcaccagcuggcugacgaucgggaucuccggccccgacaacggcgccguggccgugcugaaguacaacgggaucaucaccgacaccaucaagagcuggcggaacaacauccuccgcacccaggaguccgagugcgcgugcgucaacggcagcugcuucacggugaugaccgacgggccguccaacggccaggccagccacaagaucuucaagauggagaagggcaagguggucaaguccguggagcuggacgcccccaacuaccacuacgaggagugcagcugcuaccccgacgccggggagaucaccugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccguguccagcaacggcgccgggggcgucaagggguucuccuucaaguacggcaacggcguguggaucgggcgcacgaagagcaccaacucccggagcggcuucgagaugaucugggaccccaacggguggaccgagaccgacagcuccuucagcgugaagcaggacaucgucgcgaucacggacugguccggcuacagcggguccuucgugcagcacccggagcucaccggccuggacugcauccgccccugcuucugggucgagcugauccggggccgccccaaggagagcaccaucuggaccuccgggagcuccaucagcuucugcggcgugaacuccgacacggugggguggagcuggcccgacggcgccgagcucccguucaccaucgacaaguga

SEQ ID NO: 213747 - RNA, 1627 nt, Artificial Sequence
  R2031/R2032/R2518 mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcggaucggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213748 - RNA, 1792 nt, Artificial Sequence
  R2669/R2670 mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcggaucggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213749 - RNA, 1627 nt, Artificial Sequence
  mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuacaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213750 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuacaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213751 - RNA, 1627 nt, Artificial Sequence
  mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggggcagcucccucugcccggucagcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucggcaucuccgggcccgacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggcccguccaacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213752 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggggcagcucccucugcccggucagcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucggcaucuccgggcccgacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggcccguccaacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213753 - RNA, 1627 nt, Artificial Sequence
  mRNA product opt Design1 from Influenza A H1N1 neuraminidase
gggagaaagcuuaccaugaaccccaaccagaagaucaucaccaucggcagcaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccugugcccggucuccggcugggccaucuacagcaaggacaacuccgugcgcaucggcagcaagggggacguguucgucauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcugaccaucggcaucagcggccccgacuccggggccgucgccgugcucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaaggcccccaacuaccacuacgaggagugcagcugcuaccccgacuccagcgagaucacgugcgugugccgggacaacuggcacggcuccaaccgccccugggugagcuucaaccagaaccuggaguaccagaugggguacaucugcuccggcgucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccgucgggugguccuggcccgacggcgccgagcucccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213754 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccugugcccggucuccggcugggccaucuacagcaaggacaacuccgugcgcaucggcagcaagggggacguguucgucauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcugaccaucggcaucagcggccccgacuccggggccgucgccgugcucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaaggcccccaacuaccacuacgaggagugcagcugcuaccccgacuccagcgagaucacgugcgugugccgggacaacuggcacggcuccaaccgccccugggugagcuucaaccagaaccuggaguaccagaugggguacaucugcuccggcgucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccgucgggugguccuggcccgacggcgccgagcucccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213755 - RNA, 1627 nt, Artificial Sequence
  R2426/R2428 mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgggugggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucauccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213756 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgggugggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucauccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213757 - RNA, 1627 nt, Artificial Sequence
  mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccgagaccgacaacaacuucagcaucaagcaggacaucgucggcaucaacgagugguccggguacagcggcuccuucauccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213758 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccgagaccgacaacaacuucagcaucaagcaggacaucgucggcaucaacgagugguccggguacagcggcuccuucauccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213759 - RNA, 1627 nt, Artificial Sequence
  mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcgugcgcgugggcuccaagggggacgucuucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcugaccaucggcaucuccggccccgacaacggggccguggccgugcucaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucauccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213760 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcgugcgcgugggcuccaagggggacgucuucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcugaccaucggcaucuccggccccgacaacggggccguggccgugcucaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucauccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213761 - RNA, 1627 nt, Artificial Sequence
  mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucgccuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucauccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213762 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucgccuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucauccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213763 - RNA, 1627 nt, Artificial Sequence
  mRNA product opt Design1 from Influenza A H1N1 neuraminidase
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213764 - RNA, 1792 nt, Artificial Sequence
  mRNA product opt Design2 from Influenza A H1N1 neuraminidase
ggggcgcugccuacggagguggcagccaucuccuucucggcaucaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213765 - RNA, 1627 nt, Artificial Sequence
  R5176/R5478 mRNA product opt Design1 from Influenza A H3N2 neuraminidase
gggagaaagcuuaccaugaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgucugcaucaccggggacgacaagaacgcgaccgccagcuucaucuacaacggccggcucguggacuccguggucagcugguccaaggacauccugcgcacccaggagagcgagugcaucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgcccgaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaacccgaagagcaagcugcagaccaaccgccaggucaucguggaccggggcgaccgcuccggguacagcgggaucuucuccguggagggcaagagcugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213766 - RNA, 1792 nt, Artificial Sequence
  mRNA product opt Design2 from Influenza A H3N2 neuraminidase
ggggcgcugccuacggagguggcagccaucuccuucucggcaucaagcuuaccaugaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgucugcaucaccggggacgacaagaacgcgaccgccagcuucaucuacaacggccggcucguggacuccguggucagcugguccaaggacauccugcgcacccaggagagcgagugcaucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgcccgaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaacccgaagagcaagcugcagaccaaccgccaggucaucguggaccggggcgaccgcuccggguacagcgggaucuucuccguggagggcaagagcugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213767 - RNA, 1627 nt, Artificial Sequence
  mRNA product opt Design1 from Influenza A H3N2 neuraminidase
gggagaaagcuuaccaugaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaagguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggacauccugcgcacccaggagagcgagugcaucugcaucaacgggaccugcacgguggugaugaccgacggcuccgccagcggcaaggccgacaccaagauccuguucaucgaggaggggaagaucguccacaccagcacgcucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagacguucaaggugaucgagggcugguccaaccccaagagcaagcugcagaccaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213768 - RNA, 1792 nt, Artificial Sequence
  mRNA product opt Design2 from Influenza A H3N2 neuraminidase
ggggcgcugccuacggagguggcagccaucuccuucucggcaucaagcuuaccaugaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaagguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggacauccugcgcacccaggagagcgagugcaucugcaucaacgggaccugcacgguggugaugaccgacggcuccgccagcggcaaggccgacaccaagauccuguucaucgaggaggggaagaucguccacaccagcacgcucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagacguucaaggugaucgagggcugguccaaccccaagagcaagcugcagaccaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213769 - RNA, 1567 nt, Artificial Sequence
  R1706/R1707 mRNA product opt Design1 from Influenza A H5N1 neuraminidase
gggagaaagcuuaccaugaaccccaaccagaagaucaucaccaucggcagcaucugcauggugaucgggaucgucucccugaugcuccagaucggcaacaugaucagcaucugggugucccacagcauccagaccgggaaccagcggcaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccaucaaggaccgcagcccccaccggacccugauguccugcccggugggggaggcccccagccccuacaacucccgcuucgagagcguggcguggagcgccuccgccugccacgacggcaccagcuggcucacgaucgggaucuccggccccgacaacggcgccgucgcggugcugaaguacaacgggaucaucaccgacaccaucaagagcuggcggaacaacauccugcgcacccaggaguccgagugcgccugcgugaacggcagcugcuucacggucaugaccgacgggccguccagcggccaggccuccuacaagaucuucaagauggagaagggcaagguggugaagagcgucgagcucgacgcccccaacuaccacuacgaggagugcuccugcuaccccgacgccggggagaucaccugcgugugccgggacaacuggcacggcagcaaccgccccuggguguccuucaaccagaaccuggaguaccagaucggguacaucugcagcggcgucuucggggacaacccgcggcccaacgacggcaccggcuccugcgggcccgugagccccaacggcgcguacggggugaagggcuucuccuucaaguacgggaacggcgucuggaucggccgcacgaagagcaccaacucccggagcggguucgagaugaucugggacccgaacggcuggaccgggaccgacagcuccuucagcgugaagcaggacaucguggccaucacggacugguccggcuacagcggguccuucguccagcaccccgagcugaccggccucgacugcauccgccccugcuucuggguggagcugauccggggccgccccaaggagagcaccaucuggaccuccgggagcuccaucagcuucugcggcgucaacuccgacacggugagcugguccuggccggacggggccgagcugcccuucaccaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213770 - RNA, 1732 nt, Artificial Sequence
  mRNA product opt Design2 from Influenza A H5N1 neuraminidase
ggggcgcugccuacggagguggcagccaucuccuucucggcaucaagcuuaccaugaaccccaaccagaagaucaucaccaucggcagcaucugcauggugaucgggaucgucucccugaugcuccagaucggcaacaugaucagcaucugggugucccacagcauccagaccgggaaccagcggcaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccaucaaggaccgcagcccccaccggacccugauguccugcccggugggggaggcccccagccccuacaacucccgcuucgagagcguggcguggagcgccuccgccugccacgacggcaccagcuggcucacgaucgggaucuccggccccgacaacggcgccgucgcggugcugaaguacaacgggaucaucaccgacaccaucaagagcuggcggaacaacauccugcgcacccaggaguccgagugcgccugcgugaacggcagcugcuucacggucaugaccgacgggccguccagcggccaggccuccuacaagaucuucaagauggagaagggcaagguggugaagagcgucgagcucgacgcccccaacuaccacuacgaggagugcuccugcuaccccgacgccggggagaucaccugcgugugccgggacaacuggcacggcagcaaccgccccuggguguccuucaaccagaaccuggaguaccagaucggguacaucugcagcggcgucuucggggacaacccgcggcccaacgacggcaccggcuccugcgggcccgugagccccaacggcgcguacggggugaagggcuucuccuucaaguacgggaacggcgucuggaucggccgcacgaagagcaccaacucccggagcggguucgagaugaucugggacccgaacggcuggaccgggaccgacagcuccuucagcgugaagcaggacaucguggccaucacggacugguccggcuacagcggguccuucguccagcaccccgagcugaccggccucgacugcauccgccccugcuucuggguggagcugauccggggccgccccaaggagagcaccaucuggaccuccgggagcuccaucagcuucugcggcgucaacuccgacacggugagcugguccuggccggacggggccgagcugcccuucaccaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213771 - RNA, 1567 nt, Artificial Sequence
  R1704/R1705/R2442 mRNA product opt Design1 from Influenza A H5N1 neuraminidase
gggagaaagcuuaccaugaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaaccugcugaccgagaaggccguggccuccgucaagcucgcgggcaacagcucccugugccccaucaacgggugggccguguacagcaaggacaacuccauccggaucggcagcaagggcgacguguucgucauccgcgagcccuucaucuccugcagccaccuggagugccggaccuucuuccucacgcagggggcccugcugaacgacaagcacuccaacggcaccgugaaggaccgcagcccccaccggacccucauguccugcccggugggggaggcccccagccccuacaacucccgcuucgagagcgucgccuggagcgcguccgccugccacgacggcaccagcuggcugacgaucgggaucuccggccccgacaacggcgccguggccgugcugaaguacaacgggaucaucaccgacaccaucaagagcuggcggaacaacauccuccgcacccaggaguccgagugcgcgugcgucaacggcagcugcuucacggugaugaccgacgggccguccaacggccaggccagccacaagaucuucaagauggagaagggcaagguggucaaguccguggagcuggacgcccccaacuaccacuacgaggagugcagcugcuaccccgacgccggggagaucaccugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccguguccagcaacggcgccgggggcgucaagggguucuccuucaaguacggcaacggcguguggaucgggcgcacgaagagcaccaacucccggagcggcuucgagaugaucugggaccccaacggguggaccgagaccgacagcuccuucagcgugaagcaggacaucgucgcgaucacggacugguccggcuacagcggguccuucgugcagcacccggagcucaccggccuggacugcauccgccccugcuucugggucgagcugauccggggccgccccaaggagagcaccaucuggaccuccgggagcuccaucagcuucugcggcgugaacuccgacacggugggguggagcuggcccgacggcgccgagcucccguucaccaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213772 - RNA, 1732 nt, Artificial Sequence
  mRNA product opt Design2 from Influenza A H5N1 neuraminidase
ggggcgcugccuacggagguggcagccaucuccuucucggcaucaagcuuaccaugaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaaccugcugaccgagaaggccguggccuccgucaagcucgcgggcaacagcucccugugccccaucaacgggugggccguguacagcaaggacaacuccauccggaucggcagcaagggcgacguguucgucauccgcgagcccuucaucuccugcagccaccuggagugccggaccuucuuccucacgcagggggcccugcugaacgacaagcacuccaacggcaccgugaaggaccgcagcccccaccggacccucauguccugcccggugggggaggcccccagccccuacaacucccgcuucgagagcgucgccuggagcgcguccgccugccacgacggcaccagcuggcugacgaucgggaucuccggccccgacaacggcgccguggccgugcugaaguacaacgggaucaucaccgacaccaucaagagcuggcggaacaacauccuccgcacccaggaguccgagugcgcgugcgucaacggcagcugcuucacggugaugaccgacgggccguccaacggccaggccagccacaagaucuucaagauggagaagggcaagguggucaaguccguggagcuggacgcccccaacuaccacuacgaggagugcagcugcuaccccgacgccggggagaucaccugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccguguccagcaacggcgccgggggcgucaagggguucuccuucaaguacggcaacggcguguggaucgggcgcacgaagagcaccaacucccggagcggcuucgagaugaucugggaccccaacggguggaccgagaccgacagcuccuucagcgugaagcaggacaucgucgcgaucacggacugguccggcuacagcggguccuucgugcagcacccggagcucaccggccuggacugcauccgccccugcuucugggucgagcugauccggggccgccccaaggagagcaccaucuggaccuccgggagcuccaucagcuucugcggcgugaacuccgacacggugggguggagcuggcccgacggcgccgagcucccguucaccaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213773 - RNA, 1567 nt, Artificial Sequence
  mRNA product opt Design1 from Influenza A H5N1 neuraminidase
gggagaaagcuuaccaugaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcucccucugccccaucaacgggugggccguguacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacauccugcggacccaggaguccgagugcgcgugcgucaacggcagcugcuucacggugaugaccgacgggccguccaacggccaggccagccacaagaucuucaagauggagaagggcaagguggucaaguccguggagcucgacgcccccaacuaccacuacgaggagugcagcugcuaccccaacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccguguccagcaacggcgccuacggggucaagggcuucuccuucaaguacgggaacggcguguggaucggccggaccaagagcaccaacucccgcagcggguucgagaugaucugggaccccaacggcuggaccgagaccgacagcuccuucagcgugaagcaggacaucgucgcgaucacggacugguccggguacagcggcuccuucgugcagcacccggagcugaccgggcucgacugcauccggcccugcuucugggucgagcugauccgcggccggcccaaggagagcaccaucuggaccuccggcagcuccaucagcuucugcggggugaacuccgacacggugggcuggagcuggcccgacggggccgagcugccguucaccaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213774 - RNA, 1732 nt, Artificial Sequence
  mRNA product opt Design2 from Influenza A H5N1 neuraminidase
ggggcgcugccuacggagguggcagccaucuccuucucggcaucaagcuuaccaugaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcucccucugccccaucaacgggugggccguguacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacauccugcggacccaggaguccgagugcgcgugcgucaacggcagcugcuucacggugaugaccgacgggccguccaacggccaggccagccacaagaucuucaagauggagaagggcaagguggucaaguccguggagcucgacgcccccaacuaccacuacgaggagugcagcugcuaccccaacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccguguccagcaacggcgccuacggggucaagggcuucuccuucaaguacgggaacggcguguggaucggccggaccaagagcaccaacucccgcagcggguucgagaugaucugggaccccaacggcuggaccgagaccgacagcuccuucagcgugaagcaggacaucgucgcgaucacggacugguccggguacagcggcuccuucgugcagcacccggagcugaccgggcucgacugcauccggcccugcuucugggucgagcugauccgcggccggcccaaggagagcaccaucuggaccuccggcagcuccaucagcuucugcggggugaacuccgacacggugggcuggagcuggcccgacggggccgagcugccguucaccaucgacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213775 - RNA, 1615 nt, Artificial Sequence
  mRNA product opt Design1 from Influenza A H7N9 neuraminidase
gggagaaagcuuaccaugaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggagcugauccgcggccggcccaaggaggacaaggugugguggaccuccaacagcaucgucuccaugugcagcagcaccgaguuccucgggcaguggaacuggcccgacggcgccaagaucgaguacuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213776 - RNA, 1780 nt, Artificial Sequence
  mRNA product opt Design2 from Influenza A H7N9 neuraminidase
ggggcgcugccuacggagguggcagccaucuccuucucggcaucaagcuuaccaugaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggagcugauccgcggccggcccaaggaggacaaggugugguggaccuccaacagcaucgucuccaugugcagcagcaccgaguuccucgggcaguggaacuggcccgacggcgccaagaucgaguacuuccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213777 - RNA, 1618 nt, Artificial Sequence
  R5175/R5476 mRNA product opt Design1 from Influenza B neuraminidase
gggagaaagcuuaccaugcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213778 - RNA, 1783 nt, Artificial Sequence
  mRNA product opt Design2 from Influenza B neuraminidase
ggggcgcugccuacggagguggcagccaucuccuucucggcaucaagcuuaccaugcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213779 - RNA, 1618 nt, Artificial Sequence
  mRNA product opt Design1 from Influenza B neuraminidase
gggagaaagcuuaccaugcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213780 - RNA, 1783 nt, Artificial Sequence
  mRNA product opt Design2 from Influenza B neuraminidase
ggggcgcugccuacggagguggcagccaucuccuucucggcaucaagcuuaccaugcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213781 - RNA, 1618 nt, Artificial Sequence
  mRNA product opt Design1 from Influenza B neuraminidase
gggagaaagcuuaccaugcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaaccacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuacaacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaaguggcugggcggcaucaagggcggguucgugcaccagcggauggccagcaagaucgggcgcugguacucccggaccaugagcaagaccaaccgcaugggcauggagcucuacgugaaguacgacggggaccccuggaccgacuccgacgcccugacccugagcggcgucaugguguccaucgaggagcccggcugguacagcuucggguucgagaucaaggacaagaagugcgacgugccgugcaucggcaucgagaugguccacgacgggggcaaggacaccuggcacuccgcggccaccgccaucuacugccucauggggagcggccagcugcugugggacacggugaccggcguggacauggcccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213782 - RNA, 1783 nt, Artificial Sequence
  mRNA product opt Design2 from Influenza B neuraminidase
ggggcgcugccuacggagguggcagccaucuccuucucggcaucaagcuuaccaugcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaaccacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuacaacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaaguggcugggcggcaucaagggcggguucgugcaccagcggauggccagcaagaucgggcgcugguacucccggaccaugagcaagaccaaccgcaugggcauggagcucuacgugaaguacgacggggaccccuggaccgacuccgacgcccugacccugagcggcgucaugguguccaucgaggagcccggcugguacagcuucggguucgagaucaaggacaagaagugcgacgugccgugcaucggcaucgagaugguccacgacgggggcaaggacaccuggcacuccgcggccaccgccaucuacugccucauggggagcggccagcugcugugggacacggugaccggcguggacauggcccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213783 - RNA, 1618 nt, Artificial Sequence
  mRNA product opt Design1 from Influenza B neuraminidase
gggagaaagcuuaccaugcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaacuacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuaccacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaagggccugggcgggaucaagggcggguucgugcaccagcggauggccuucaagaucggccgcugguacagccggaccauguccaagaccaaccgcauggggauggagcucuacgugaaguacgacggcgaccccuggaccgacagcgacgcccugacccuguccggcgucauggugagcaucgaggagcccgggugguacuccuucggcuucgagaucaaggacaagaagugcgacgugccgugcaucgggaucgagaugguccacgacggcggggaggacaccuggcacagcgcggccaccgccaucuacugccucaugggcuccggccagcugcugugggacacggugaccgggaucgacauggcccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213784 - RNA, 1783 nt, Artificial Sequence
  mRNA product opt Design2 from Influenza B neuraminidase
ggggcgcugccuacggagguggcagccaucuccuucucggcaucaagcuuaccaugcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaacuacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuaccacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaagggccugggcgggaucaagggcggguucgugcaccagcggauggccuucaagaucggccgcugguacagccggaccauguccaagaccaaccgcauggggauggagcucuacgugaaguacgacggcgaccccuggaccgacagcgacgcccugacccuguccggcgucauggugagcaucgaggagcccgggugguacuccuucggcuucgagaucaaggacaagaagugcgacgugccgugcaucgggaucgagaugguccacgacggcggggaggacaccuggcacagcgcggccaccgccaucuacugccucaugggcuccggccagcugcugugggacacggugaccgggaucgacauggcccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213785 - RNA, 1618 nt, Artificial Sequence
  mRNA product opt Design1 from Influenza B neuraminidase
gggagaaagcuuaccaugcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaucaaggggaacuccgcgccccucaucauccgcgagccguucaucgccugcggccccaccgagugcaagcacuucgcccugacgcacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcgcacccaggagagcgccugcaacugcaucggcggggacugcuaccugaugaucaccgacggccccgccagcggcguguccgagugccgguuccucaagauccgcgaggggcggaucaucaaggagaucuuccccacgggccgcgugaagcacaccgaggagugcacgugcggguucgcgagcaacaagaccaucgagugcgccugccgggacaaccgcuacaccgccaagcggcccuucgucaagcugaacguggagaccgacaccgccgagauccgccugaugugcaccgagacguaccucgacaccccgcggcccaacgacggcuccaucaccgggcccugcgagagcgacggcgacaagggcuccgggggcaucaagggcggguucgugcaccagcgcauggccagcaagaucgggcggugguacucccgcaccaugagcaagacgaagcggaugggcaugggccuguacgucaaguacgacggggaccccuggaccgacuccgaggcgcuggcccucagcggcgugaugguguccauggaggagccggggugguacagcuucggcuucgagaucaaggacaagaagugcgacguccccugcaucgggaucgagauggugcacgacggcggcaagaccaccuggcacuccgccgccacggccaucuacugccugauggggagcggccagcugcucugggacaccgugaccggggucgacauggcgcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213786 - RNA, 1783 nt, Artificial Sequence
  mRNA product opt Design2 from Influenza B neuraminidase
ggggcgcugccuacggagguggcagccaucuccuucucggcaucaagcuuaccaugcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaucaaggggaacuccgcgccccucaucauccgcgagccguucaucgccugcggccccaccgagugcaagcacuucgcccugacgcacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcgcacccaggagagcgccugcaacugcaucggcggggacugcuaccugaugaucaccgacggccccgccagcggcguguccgagugccgguuccucaagauccgcgaggggcggaucaucaaggagaucuuccccacgggccgcgugaagcacaccgaggagugcacgugcggguucgcgagcaacaagaccaucgagugcgccugccgggacaaccgcuacaccgccaagcggcccuucgucaagcugaacguggagaccgacaccgccgagauccgccugaugugcaccgagacguaccucgacaccccgcggcccaacgacggcuccaucaccgggcccugcgagagcgacggcgacaagggcuccgggggcaucaagggcggguucgugcaccagcgcauggccagcaagaucgggcggugguacucccgcaccaugagcaagacgaagcggaugggcaugggccuguacgucaaguacgacggggaccccuggaccgacuccgaggcgcuggcccucagcggcgugaugguguccauggaggagccggggugguacagcuucggcuucgagaucaaggacaagaagugcgacguccccugcaucgggaucgagauggugcacgacggcggcaagaccaccuggcacuccgccgccacggccaucuacugccugauggggagcggccagcugcucugggacaccgugaccggggucgacauggcgcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213787 - protein, 470 aa, Artificial Sequence
  Influenza A H5N8 neuraminidase
MNPNQKIATIGSISLGLVVFNVLLHAVSIILMVLALGKSENNGICKGTIVREYNETVRIEKVTQWYNTSVVEYVPHWNEGAYINNTEPICDVKGFAPFSKDNGIRIGSRGHIFVIREPFVSCSPVECRTFFLTQGALLNDKHSNGTVKDRSPFRTLMSVEVGQSPNVYQARFEAVAWSATACHDGKKWMTIGVTGPDSKAVAVVHYGGVPTDVVNSWAGDILRTQESSCTCIQGNCYWVMTDGPANRQAQYRIYKANQGKIIDQTDVSFSGGHIEECSCYPNDGKVECVCRDNWTGTNRPVLVISPDLSYRVGYLCAGLPSDTPRGEDAQFVGSCTSPMGNQGYGVKGFGFRQGTDVWVGRTISRTSRSGFEIIRIKNGWTQTSKEQIRRQVVVDNLNWSGYSGSFTLPVELSGRECLVPCFWVEMIRGRPEERTIWTSSSSIVMCGVDHEIADWSWHDGAILPFDIDKM

SEQ ID NO: 213788 - RNA, 1413 nt, Artificial Sequence
  Influenza A H5N8 neuraminidase
augaauccaaaucagaaaauagcgaccauuggcuccauuucauuaggguugguuguauucaauguucuacugcaugccgugagcaucauauuaaugguguuagcccuggggaaaagugaaaacaauggaaucugcaagggaacuauaguaagggaauacaaugaaacaguuaggauagagaaagugacucaaugguacaauacuaguguagucgaauauguaccgcauuggaacgagggcgcuuauauaaacaacaccgaaccaauaugugaugucaagggcuuugcaccuuuuuccaaggacaacgggauaagaauuggcuccaggggacauauuuuugucauaagggagccuuucgucucuuguucaccuguagagugcagaacuuucuuccucacucagggagcucuacucaaugacaaacacucaaauggaacagugaaggauagaagcccauucagaacucucaugagugucgaagugggucaaucacccaauguguaucaagcaagguuugaagcuguagcauggucagcaacagccugucaugauggcaagaaauggaugacgauugguguaacagggccagauucuaaagcaguagcaguaguccauuacggaggggugccuacugauguuguuaacuccugggcgggagauauauuaaggacucaggagucaucuuguacuugcauucaagguaauuguuauuggguaaugacugacgguccagccaauagacaggcgcaguauagaauauacaaagcaaaucaaggcaaaauaauugaccaaacagaugucagcuuuaguggaggacauauugaggaauguucuuguuauccaaaugaugguaaaguggaaugcguguguagagacaacuggacgggaacuaacaggccugugcuaguuauuucgccugaucucucuuacaggguuggguauuuaugugcaggauugcccagugacacuccaagaggggaagaugcucaauuugucgguucaugcacuagucccaugggaaaucagggauauggcguaaaagguuucggguuucgacagggaacugauguguggguggggcggacaauuagucgaaccuccaggucaggguuugaaauaauaaggauaaagaaugguuggacgcagacaagcaaagaacagauucgaaggcaggugguuguugauaauuugaauuggucgggauacagugggucuuucacuuuaccaguagaauugucugggagggaauguuuaguccccuguuuuugggucgaaaugaucagaggcaggccagaagaaagaacaaucuggaccucuaguagcuccauuguaauguguggaguugaucaugaaauugccgauuggucauggcacgauggagcuauucuucccuuugacaucgauaagauguaa

SEQ ID NO: 213789 - RNA, 1413 nt, Artificial Sequence
  derived and/or modified sequence opt from Influenza A H5N8 neuraminidase
augaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaguacgucccgcacuggaacgagggggccuacaucaacaacaccgagcccaucugcgacgugaagggcuucgcccccuucuccaaggacaacggcauccgcaucgggagccggggccacaucuucgugauccgcgagcccuucgucuccugcagcccgguggagugccggacguucuuccucacccagggggcccugcugaacgacaagcacuccaacggcaccgugaaggaccgcagccccuuccggacccucauguccgucgagguggggcagagccccaacguguaccaggcccgcuucgaggcggucgccugguccgccacggccugccacgacggcaagaaguggaugaccaucggcgugaccgggcccgacagcaaggcgguggccgucgugcacuacggcggggugccgaccgacgucgugaacuccugggccggcgacauccugcggacgcaggagagcuccugcacgugcauccagggcaacugcuacugggucaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaagguggagugcgucugccgcgacaacuggaccggcaccaaccggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuucggguuccgccagggcaccgacgucuggguggggcggaccaucucccgcaccagccgguccggcuucgagaucauccgcaucaagaacggguggacccagacgagcaaggagcagauccggcgccagguggucguggacaaccucaacugguccggcuacagcggcuccuucacccugccgguggagcugagcgggcgcgagugccucguccccugcuucuggguggagaugauccggggccgccccgaggagcggaccaucuggaccuccagcuccagcaucgugaugugcggggucgaccacgagaucgccgacugguccuggcacgacggcgccauccugcccuucgacaucgacaagauguga

SEQ ID NO: 213790 - RNA, 1630 nt, Artificial Sequence
  mRNA product opt Design1 from Influenza A H5N8 neuraminidase
gggagaaagcuuaccaugaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaguacgucccgcacuggaacgagggggccuacaucaacaacaccgagcccaucugcgacgugaagggcuucgcccccuucuccaaggacaacggcauccgcaucgggagccggggccacaucuucgugauccgcgagcccuucgucuccugcagcccgguggagugccggacguucuuccucacccagggggcccugcugaacgacaagcacuccaacggcaccgugaaggaccgcagccccuuccggacccucauguccgucgagguggggcagagccccaacguguaccaggcccgcuucgaggcggucgccugguccgccacggccugccacgacggcaagaaguggaugaccaucggcgugaccgggcccgacagcaaggcgguggccgucgugcacuacggcggggugccgaccgacgucgugaacuccugggccggcgacauccugcggacgcaggagagcuccugcacgugcauccagggcaacugcuacugggucaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaagguggagugcgucugccgcgacaacuggaccggcaccaaccggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuucggguuccgccagggcaccgacgucuggguggggcggaccaucucccgcaccagccgguccggcuucgagaucauccgcaucaagaacggguggacccagacgagcaaggagcagauccggcgccagguggucguggacaaccucaacugguccggcuacagcggcuccuucacccugccgguggagcugagcgggcgcgagugccucguccccugcuucuggguggagaugauccggggccgccccgaggagcggaccaucuggaccuccagcuccagcaucgugaugugcggggucgaccacgagaucgccgacugguccuggcacgacggcgccauccugcccuucgacaucgacaagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213791 - RNA, 1795 nt, Artificial Sequence
  R5818 mRNA product opt Design2 from Influenza A H5N8 neuraminidase
ggggcgcugccuacggagguggcagccaucuccuucucggcaucaagcuuaccaugaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaguacgucccgcacuggaacgagggggccuacaucaacaacaccgagcccaucugcgacgugaagggcuucgcccccuucuccaaggacaacggcauccgcaucgggagccggggccacaucuucgugauccgcgagcccuucgucuccugcagcccgguggagugccggacguucuuccucacccagggggcccugcugaacgacaagcacuccaacggcaccgugaaggaccgcagccccuuccggacccucauguccgucgagguggggcagagccccaacguguaccaggcccgcuucgaggcggucgccugguccgccacggccugccacgacggcaagaaguggaugaccaucggcgugaccgggcccgacagcaaggcgguggccgucgugcacuacggcggggugccgaccgacgucgugaacuccugggccggcgacauccugcggacgcaggagagcuccugcacgugcauccagggcaacugcuacugggucaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaagguggagugcgucugccgcgacaacuggaccggcaccaaccggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuucggguuccgccagggcaccgacgucuggguggggcggaccaucucccgcaccagccgguccggcuucgagaucauccgcaucaagaacggguggacccagacgagcaaggagcagauccggcgccagguggucguggacaaccucaacugguccggcuacagcggcuccuucacccugccgguggagcugagcgggcgcgagugccucguccccugcuucuggguggagaugauccggggccgccccgaggagcggaccaucuggaccuccagcuccagcaucgugaugugcggggucgaccacgagaucgccgacugguccuggcacgacggcgccauccugcccuucgacaucgacaagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213792 - protein, 470 aa, Artificial Sequence
  Influenza A H5N8 neuraminidase
MNPNQKIATIGSISLGLVVFNVLLHAVSIILMVLALGKSENNGICKGTIVREYNETVRIEKVTQWYNTSVVEYVPHWNEGAYINNTEPICDVKGFAPFSKDNGIRVGSRGHIFVIREPFVSCSPVECRTFFLTQGALLNDKHSNGTVKDRSPFRTLMSVEVGQSPNVYQARFEAVAWSATACHDGKKWMTIGVTGPDSKAVAVVHYGGVPTDVVNSWAGDILRTQESSCTCIQGNCYWVMTDGPANRQAQYRIYKANQGKIIDQTDVSFSGGHIEECSCYPNDGKVECVCRDNWMGTNRPVLVISPDLSYRVGYLCAGLPSDTPRGEDAQFVGSCTSPMGNQGYGVKGFGFRQGTDVWVGRTISRTSRSGFEIIRIKNGWTQTSKEQIRRQVVVDNLNWSGYSGSFTLPVELSGRECLVPCFWVEMIRGRPEERTIWTSSSSIVMCGVDHEIADWSWHDGAILPFDIDKM

SEQ ID NO: 213793 - RNA, 1413 nt, Artificial Sequence
  Influenza A H5N8 neuraminidase
augaauccaaaucagaaaauagcgaccauuggcuccauuucauuaggauugguuguauucaauguucuacugcaugccgugagcaucauauuaaugguguuagcccuggggaaaagugaaaacaauggaaucugcaagggaacuauaguaagggaauauaaugaaacaguuaggauagagaaagugacucaaugguacaauacuaguguagucgaauauguaccgcauuggaacgagggcgcuuauauaaacaacaccgaaccaauaugugaugucaagggcuuugcaccuuuuuccaaggacaacgggauaagaguuggcuccaggggacauauuuuugucauaagggagccuuucgucucuuguucaccuguagagugcagaacuuucuuccucacucagggagcucuacucaaugacaaacacucaaauggaacagugaaggauagaagcccauucagaacucucaugagugucgaagugggucaaucacccaauguguaucaagcaagguuugaagcuguagcauggucagcaacagccugucaugauggcaagaaauggaugacgauugguguaacagggccagauucuaaagcaguagcaguaguccauuacggaggggugccuacugauguuguuaauuccugggcgggagauauauuaaggacucaggagucgucuuguacuugcauucaagguaauuguuauuggguaaugacugacgguccagccaauagacaggcgcaguauagaauauacaaagcaaaucaaggcaaaauaauugaccaaacagaugucagcuuuaguggaggacauauugaggaauguucuuguuauccaaaugaugguaaaguggaaugcguguguagagacaacuggaugggaacuaacaggccugugcuaguuauuucgccugaucucucuuacaggguuggguauuuaugugcgggauugcccagugacacuccaagaggggaagaugcucaauuugucgguucaugcacuagucccaugggaaaucagggauauggcguaaaagguuucggguuucgacagggaacugauguguggguggggcggacaauuagucgaaccuccaggucaggguuugaaauaauaaggauaaagaaugguuggacgcagacaagcaaagaacagauuagaaggcaggugguuguugauaauuugaauuggucgggauacagugggucuuucacuuuaccaguagaauugucugggagggaauguuuaguccccuguuuuugggucgaaaugaucagaggcaggccagaagaaagaacaaucuggaccucuaguagcuccauuguaauguguggaguugaucaugaaauugccgauuggucauggcacgauggagcuauucuucccuuugacaucgauaagauguaa

SEQ ID NO: 213794 - RNA, 1413 nt, Artificial Sequence
  derived and/or modified sequence opt from Influenza A H5N8 neuraminidase
augaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaguacgucccgcacuggaacgagggggccuacaucaacaacaccgagcccaucugcgacgugaagggcuucgcccccuucuccaaggacaacggcauccgcguggggagccggggccacaucuucgucauccgcgagcccuucguguccugcagcccgguggagugccggacguucuuccucacccagggggcccugcugaacgacaagcacuccaacggcaccgucaaggaccgcagccccuuccggacccucauguccguggagguggggcagagccccaacgucuaccaggcccgcuucgaggcgguggccugguccgccacggccugccacgacggcaagaaguggaugaccaucggcgugaccgggcccgacagcaaggcggucgccguggugcacuacggcggggucccgaccgacguggucaacuccugggccggcgacauccugcggacgcaggagagcuccugcacgugcauccagggcaacugcuacugggugaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaaggucgagugcgugugccgcgacaacuggaugggcaccaaccggcccgugcuggucaucagcccggaccucuccuaccgcgugggcuaccugugcgccgggcugcccagcgacacgccccggggcgaggacgcccaguucgugggguccugcaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcagauccggcgccaggucgugguggacaaccucaacugguccggcuacagcggcuccuucacgcugccggucgagcugagcgggcgcgagugccucgugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagauguga

SEQ ID NO: 213795 - RNA, 1630 nt, Artificial Sequence
  mRNA product opt Design1 from Influenza A H5N8 neuraminidase
gggagaaagcuuaccaugaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaguacgucccgcacuggaacgagggggccuacaucaacaacaccgagcccaucugcgacgugaagggcuucgcccccuucuccaaggacaacggcauccgcguggggagccggggccacaucuucgucauccgcgagcccuucguguccugcagcccgguggagugccggacguucuuccucacccagggggcccugcugaacgacaagcacuccaacggcaccgucaaggaccgcagccccuuccggacccucauguccguggagguggggcagagccccaacgucuaccaggcccgcuucgaggcgguggccugguccgccacggccugccacgacggcaagaaguggaugaccaucggcgugaccgggcccgacagcaaggcggucgccguggugcacuacggcggggucccgaccgacguggucaacuccugggccggcgacauccugcggacgcaggagagcuccugcacgugcauccagggcaacugcuacugggugaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaaggucgagugcgugugccgcgacaacuggaugggcaccaaccggcccgugcuggucaucagcccggaccucuccuaccgcgugggcuaccugugcgccgggcugcccagcgacacgccccggggcgaggacgcccaguucgugggguccugcaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcagauccggcgccaggucgugguggacaaccucaacugguccggcuacagcggcuccuucacgcugccggucgagcugagcgggcgcgagugccucgugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213796 - RNA, 1795 nt, Artificial Sequence
  R5820 mRNA product opt Design2 from Influenza A H5N8 neuraminidase
ggggcgcugccuacggagguggcagccaucuccuucucggcaucaagcuuaccaugaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaguacgucccgcacuggaacgagggggccuacaucaacaacaccgagcccaucugcgacgugaagggcuucgcccccuucuccaaggacaacggcauccgcguggggagccggggccacaucuucgucauccgcgagcccuucguguccugcagcccgguggagugccggacguucuuccucacccagggggcccugcugaacgacaagcacuccaacggcaccgucaaggaccgcagccccuuccggacccucauguccguggagguggggcagagccccaacgucuaccaggcccgcuucgaggcgguggccugguccgccacggccugccacgacggcaagaaguggaugaccaucggcgugaccgggcccgacagcaaggcggucgccguggugcacuacggcggggucccgaccgacguggucaacuccugggccggcgacauccugcggacgcaggagagcuccugcacgugcauccagggcaacugcuacugggugaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaaggucgagugcgugugccgcgacaacuggaugggcaccaaccggcccgugcuggucaucagcccggaccucuccuaccgcgugggcuaccugugcgccgggcugcccagcgacacgccccggggcgaggacgcccaguucgugggguccugcaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcagauccggcgccaggucgugguggacaaccucaacugguccggcuacagcggcuccuucacgcugccggucgagcugagcgggcgcgagugccucgugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213797 - protein, 470 aa, Artificial Sequence
  Influenza A H5N8 neuraminidase
MNPNQKIATIGSISLGLAVFNVLLHAVSIILMVLALGKSENNGICKGTIVREYNETVRIEKVTQWYNTSVVEYVPHWNEGTYINNTEPICDVKGFAPFSKDNGIRVGSRGHIFVIREPFVSCSPVECRTFFLTQGALLNDKHSNGTVKDRSPFRTLMSVEVGQSPNVYQARFEAVAWSATACHDGKKWMTIGVTGPDSKAVAVVHYGGVPTDVVNSWAGDILRTQESSCTCIQGNCYWVMTDGPANRQAQYRIYKANQGKIIDQTDVSFSGGHIEECSCYPNDGKVECVCRDNWTGTNRPVLVISPDLSYRVGYLCAGLPSDTPRGEDAQFVGSCTSPMGNQGYGVKGFGFRQGTDVWVGRTISRTSRSGFEIIRIKNGWTQTSKEQIRRQVVVDNLNWSGYSGSFTLPVELSGRECLVPCFWVEMIRGRPEERTIWTSSSSIVMCGVDHEIADWSWHDGAVLPFDIDKM

SEQ ID NO: 213798 - RNA, 1413 nt, Artificial Sequence
  Influenza A H5N8 neuraminidase
augaauccaaaucagaaaauagcgaccauuggcuccauuucauuagggcuggcuguauucaauguucuacugcaugccgugagcaucauauuaaugguguuagcccuggggaaaagugaaaacaauggaaucugcaagggaacuauaguaagagaauauaaugaaacaguuaggauagagaaagugacacaaugguacaauacuaguguagucgaauauguaccgcauuggaacgagggcacuuauauaaacaacaccgaaccaauaugugaugucaagggcuuugcaccuuuuuccaaggacaacgggauaagaguuggcuccagaggacauauuuuugucauaagggagccuuucgucucuuguucaccuguagagugcagaacuuucuuccucacucagggagcucuacucaaugacaaacacucaaauggaacagugaaggauagaagcccauucagaacucucaugagugucgaagugggucaaucacccaacguguaucaagcaagguuugaagcuguagcauggucagcaacagccugucaugauggcaagaaauggaugacgauugguguaacagggccagauucuaaagcaguagcaguaguccauuacggaggggugccuacugauguuguuaacuccugggcgggagauauauuaaggacucaggagucaucuuguacuugcauucaagguaauuguuauuggguaaugacugacgguccagccaauagacaggcgcaguauagaauauacaaagcaaaucaaggcaaaauaauugaccaaacagaugucagcuuuaguggaggacauauugaggaauguucuuguuauccaaaugaugguaaaguggaaugcguguguagagacaacuggacgggaacuaacaggccugugcuaguuauuucgccugaucucucuuacaggguuggguauuuaugugcaggauugcccagugacacuccaagaggggaagaugcucaauuugucgguucaugcacuagucccaugggaaaucagggauauggcguaaaagguuucggguuucgacagggaacugauguguggguggggcggacaauuagucgaaccuccaggucaggguuugaaauaauaaggauaaagaaugguuggacgcagacaagcaaagaacagauuagaaggcaggugguuguugauaauuugaauuggucgggauacagugggucuuucacuuuaccaguagaauugucugggagggaauguuuaguccccuguuuuugggucgaaaugaucagaggcaggccagaagaaagaacaaucuggaccucuaguagcuccauuguaauguguggaguugaucaugaaauugccgauuggucauggcacgauggagcuguucuucccuuugacaucgauaagauguaa

SEQ ID NO: 213799 - RNA, 1413 nt, Artificial Sequence
  derived and/or modified sequence opt from Influenza A H5N8 neuraminidase
augaaccccaaccagaagaucgccaccaucggcagcaucucccuggggcucgccguguucaacguccugcugcacgcggugagcaucauccucauggugcuggcccugggcaaguccgagaacaacgggaucugcaagggcaccaucguccgcgaguacaacgagacggugcggaucgagaaggugacccagugguacaacaccagcgucguggaguacgugccgcacuggaacgaggggaccuacaucaacaacacggagcccaucugcgacgucaagggcuucgcccccuucuccaaggacaacggcauccgcguggggagccggggccacaucuucgugauccgcgagcccuucgucuccugcagcccgguggagugccggaccuucuuccucacccagggggcccugcugaacgacaagcacuccaacggcaccgugaaggaccgcagccccuuccggacgcucauguccgucgagguggggcagagccccaacguguaccaggcccgcuucgaggcggucgccugguccgccaccgccugccacgacggcaagaaguggaugaccaucggcgugaccgggcccgacagcaaggcgguggccgucgugcacuacggcggggugccgacggacgucgugaacuccugggccggcgacauccugcggacccaggagagcuccugcacgugcauccagggcaacugcuacugggucaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaagguggagugcgucugccgcgacaacuggaccggcaccaaccggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuucggguuccgccagggcaccgacgucuggguggggcggaccaucucccgcaccagccgguccggcuucgagaucauccgcaucaagaacggguggacgcagaccagcaaggagcagauccggcgccagguggucguggacaaccucaacugguccggcuacagcggcuccuucacccugccgguggagcugagcgggcgcgagugccucguccccugcuucuggguggagaugauccggggccgccccgaggagcggaccaucuggacguccagcuccagcaucgugaugugcggggucgaccacgagaucgccgacugguccuggcacgacggcgccgugcugcccuucgacaucgacaagauguga

SEQ ID NO: 213800 - RNA, 1630 nt, Artificial Sequence
  mRNA product opt Design1 from Influenza A H5N8 neuraminidase
gggagaaagcuuaccaugaaccccaaccagaagaucgccaccaucggcagcaucucccuggggcucgccguguucaacguccugcugcacgcggugagcaucauccucauggugcuggcccugggcaaguccgagaacaacgggaucugcaagggcaccaucguccgcgaguacaacgagacggugcggaucgagaaggugacccagugguacaacaccagcgucguggaguacgugccgcacuggaacgaggggaccuacaucaacaacacggagcccaucugcgacgucaagggcuucgcccccuucuccaaggacaacggcauccgcguggggagccggggccacaucuucgugauccgcgagcccuucgucuccugcagcccgguggagugccggaccuucuuccucacccagggggcccugcugaacgacaagcacuccaacggcaccgugaaggaccgcagccccuuccggacgcucauguccgucgagguggggcagagccccaacguguaccaggcccgcuucgaggcggucgccugguccgccaccgccugccacgacggcaagaaguggaugaccaucggcgugaccgggcccgacagcaaggcgguggccgucgugcacuacggcggggugccgacggacgucgugaacuccugggccggcgacauccugcggacccaggagagcuccugcacgugcauccagggcaacugcuacugggucaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaagguggagugcgucugccgcgacaacuggaccggcaccaaccggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuucggguuccgccagggcaccgacgucuggguggggcggaccaucucccgcaccagccgguccggcuucgagaucauccgcaucaagaacggguggacgcagaccagcaaggagcagauccggcgccagguggucguggacaaccucaacugguccggcuacagcggcuccuucacccugccgguggagcugagcgggcgcgagugccucguccccugcuucuggguggagaugauccggggccgccccgaggagcggaccaucuggacguccagcuccagcaucgugaugugcggggucgaccacgagaucgccgacugguccuggcacgacggcgccgugcugcccuucgacaucgacaagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213801 - RNA, 1795 nt, Artificial Sequence
  R5820 mRNA product opt Design2 from Influenza A H5N8 neuraminidase
ggggcgcugccuacggagguggcagccaucuccuucucggcaucaagcuuaccaugaaccccaaccagaagaucgccaccaucggcagcaucucccuggggcucgccguguucaacguccugcugcacgcggugagcaucauccucauggugcuggcccugggcaaguccgagaacaacgggaucugcaagggcaccaucguccgcgaguacaacgagacggugcggaucgagaaggugacccagugguacaacaccagcgucguggaguacgugccgcacuggaacgaggggaccuacaucaacaacacggagcccaucugcgacgucaagggcuucgcccccuucuccaaggacaacggcauccgcguggggagccggggccacaucuucgugauccgcgagcccuucgucuccugcagcccgguggagugccggaccuucuuccucacccagggggcccugcugaacgacaagcacuccaacggcaccgugaaggaccgcagccccuuccggacgcucauguccgucgagguggggcagagccccaacguguaccaggcccgcuucgaggcggucgccugguccgccaccgccugccacgacggcaagaaguggaugaccaucggcgugaccgggcccgacagcaaggcgguggccgucgugcacuacggcggggugccgacggacgucgugaacuccugggccggcgacauccugcggacccaggagagcuccugcacgugcauccagggcaacugcuacugggucaugaccgacgggcccgccaaccgccaggcccaguaccggaucuacaaggcgaaccagggcaagaucaucgaccagaccgacgugagcuucuccgggggccacaucgaggagugcagcugcuaccccaacgacgggaagguggagugcgucugccgcgacaacuggaccggcaccaaccggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuucggguuccgccagggcaccgacgucuggguggggcggaccaucucccgcaccagccgguccggcuucgagaucauccgcaucaagaacggguggacgcagaccagcaaggagcagauccggcgccagguggucguggacaaccucaacugguccggcuacagcggcuccuucacccugccgguggagcugagcgggcgcgagugccucguccccugcuucuggguggagaugauccggggccgccccgaggagcggaccaucuggacguccagcuccagcaucgugaugugcggggucgaccacgagaucgccgacugguccuggcacgacggcgccgugcugcccuucgacaucgacaagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213802 - protein, 470 aa, Artificial Sequence
  Influenza A H5N8 neuraminidase
MNPNQKIATIGSISLGLVVFNVLLHAVSIILMVLALGKSENNGICKGTIVREYNETVRIEKMIQWYNTSVVEYVPHWNEGAYINNTEPICDVKGFAPFSKDNGIRIGSRGHIFVIREPFVSCSPVECRTFFLTQGALLNDKHSNGTVKDRSPFRTLMSVEVGQSPNVYQARFEAVAWSATACHDGKKWMTIGVTGPDSKAVAVVHYGGVPTDVVNSWAGDILRTQESSCTCIQGNCYWVMTDGPANRQAQYRIYKANQGKIIDQTDVSFSGGHIEECSCYPNDGKVECLCRDNWTGTNRPVLVISPDLSYRVGYLCAGLPSDTPRGEDAQFVGSCTSPMGNQGYGVKGFGFRQGTDVWVGRTISRTSRSGFEIIRIKNGWTQTSKEQIRRQVVVDNLNWSGYSGSFTLPVELSGRECLVPCFWVEMIRGRPEERTIWTSSSSIVMCGVDHEIADWSWHDGAILPFDIDKM

SEQ ID NO: 213803 - RNA, 1413 nt, Artificial Sequence
  Influenza A H5N8 neuraminidase
augaauccaaaucagaaaauagcgaccauuggcuccauuucauuaggguugguuguauucaauguucuacugcaugccgugagcaucauauuaaugguguuagcccuggggaaaagugaaaacaauggaaucugcaagggaacuauaguaagggaauauaaugaaacaguuaggauagagaaaaugauucaaugguacaauacuaguguagucgaauauguaccgcauuggaacgagggcgcuuauauaaacaacaccgaaccaauaugugaugucaagggcuuugcaccuuuuuccaaggacaacgggauaagaauuggcuccaggggacauauuuuugucauaagggagccuuucgucucuuguucaccuguagagugcagaacuuucuuccucacacagggagcucuacucaaugacaaacacucaaauggaacagugaaggauagaagcccauucagaacucucaugagugucgaagugggucaaucacccaauguguaucaagcaagguuugaagcuguagcauggucagcaacagccugccaugauggcaagaaauggaugacgauugguguaacagggccagauucuaaagcaguagcaguaguccauuacggaggggugccuacugauguuguuaacuccugggcgggagauauauuaaggacucaggagucaucuuguacuugcauucaagguaauuguuauuggguaaugacugacgguccagccaauagacaggcgcaguauagaauauacaaagcaaaucaaggcaaaauaauugaccaaacagaugucagcuuuaguggaggacauauugaggaauguucuuguuauccaaaugaugguaaaguggaaugcuuguguagagacaacuggacgggaacuaacaggccugugcuaguuauuucgccugaucucucuuacaggguuggguauuuaugugcaggauugcccagugacacuccaagaggggaagaugcucaauuugucgguucaugcacuagucccaugggaaaucagggauauggcguaaaagguuucggguuucgacagggaacugauguguggguggggcggacaauuagucgaaccuccaggucaggguuugaaauaauaaggauaaagaaugguuggacgcagacaagcaaagaacagauucgaaggcaggugguuguugauaauuugaauuggucgggauacagugggucuuucacuuuaccaguagaauugucugggagggaauguuuaguccccuguuuuugggucgaaaugaucagaggcaggccagaagaaagaacaaucuggaccucuaguagcuccauuguaauguguggaguugaucaugaaauugccgauuggucauggcacgauggagcuauucuucccuuugacaucgauaagauguaa

SEQ ID NO: 213804 - RNA, 1413 nt, Artificial Sequence
  derived and/or modified sequence opt from Influenza A H5N8 neuraminidase
augaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaagaugauccagugguacaacaccagcgucguggaguacgugccgcacuggaacgagggggccuacaucaacaacaccgagcccaucugcgacgucaagggcuucgcccccuucuccaaggacaacggcauccgcaucgggagccggggccacaucuucgugauccgcgagcccuucguguccugcagcccggucgagugccggaccuucuuccucacgcagggggcccugcugaacgacaagcacuccaacggcaccgugaaggaccgcagccccuuccggacccucauguccguggaggucgggcagagccccaacguguaccaggcccgcuucgaggcgguggccugguccgccaccgccugccacgacggcaagaaguggaugacgaucggcgucaccgggcccgacagcaaggcgguggccgugguccacuacggcggggugccgaccgacguggucaacuccugggccggcgacauccugcggacccaggagagcuccugcacgugcauccagggcaacugcuacugggugaugaccgacgggcccgccaaccgccaggcccaguaccggaucuacaaggcgaaccagggcaagaucaucgaccagaccgacgucagcuucuccgggggccacaucgaggagugcagcugcuaccccaacgacgggaagguggagugccugugccgcgacaacuggaccggcacgaaccggcccgugcucgucaucagcccggaccuguccuaccgcgugggcuaccugugcgccgggcuccccagcgacacgccccggggcgaggacgcccaguucgugggguccugcaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcagauccggcgccaggucgugguggacaaccugaacugguccggcuacagcggcuccuucacgcugccggucgagcucagcgggcgcgagugccuggugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagauguga

SEQ ID NO: 213805 - RNA, 1630 nt, Artificial Sequence
  mRNA product opt Design1 from Influenza A H5N8 neuraminidase
gggagaaagcuuaccaugaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaagaugauccagugguacaacaccagcgucguggaguacgugccgcacuggaacgagggggccuacaucaacaacaccgagcccaucugcgacgucaagggcuucgcccccuucuccaaggacaacggcauccgcaucgggagccggggccacaucuucgugauccgcgagcccuucguguccugcagcccggucgagugccggaccuucuuccucacgcagggggcccugcugaacgacaagcacuccaacggcaccgugaaggaccgcagccccuuccggacccucauguccguggaggucgggcagagccccaacguguaccaggcccgcuucgaggcgguggccugguccgccaccgccugccacgacggcaagaaguggaugacgaucggcgucaccgggcccgacagcaaggcgguggccgugguccacuacggcggggugccgaccgacguggucaacuccugggccggcgacauccugcggacccaggagagcuccugcacgugcauccagggcaacugcuacugggugaugaccgacgggcccgccaaccgccaggcccaguaccggaucuacaaggcgaaccagggcaagaucaucgaccagaccgacgucagcuucuccgggggccacaucgaggagugcagcugcuaccccaacgacgggaagguggagugccugugccgcgacaacuggaccggcacgaaccggcccgugcucgucaucagcccggaccuguccuaccgcgugggcuaccugugcgccgggcuccccagcgacacgccccggggcgaggacgcccaguucgugggguccugcaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcagauccggcgccaggucgugguggacaaccugaacugguccggcuacagcggcuccuucacgcugccggucgagcucagcgggcgcgagugccuggugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213806 - RNA, 1795 nt, Artificial Sequence
  R5820 mRNA product opt Design2 from Influenza A H5N8 neuraminidase
ggggcgcugccuacggagguggcagccaucuccuucucggcaucaagcuuaccaugaaccccaaccagaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaagaugauccagugguacaacaccagcgucguggaguacgugccgcacuggaacgagggggccuacaucaacaacaccgagcccaucugcgacgucaagggcuucgcccccuucuccaaggacaacggcauccgcaucgggagccggggccacaucuucgugauccgcgagcccuucguguccugcagcccggucgagugccggaccuucuuccucacgcagggggcccugcugaacgacaagcacuccaacggcaccgugaaggaccgcagccccuuccggacccucauguccguggaggucgggcagagccccaacguguaccaggcccgcuucgaggcgguggccugguccgccaccgccugccacgacggcaagaaguggaugacgaucggcgucaccgggcccgacagcaaggcgguggccgugguccacuacggcggggugccgaccgacguggucaacuccugggccggcgacauccugcggacccaggagagcuccugcacgugcauccagggcaacugcuacugggugaugaccgacgggcccgccaaccgccaggcccaguaccggaucuacaaggcgaaccagggcaagaucaucgaccagaccgacgucagcuucuccgggggccacaucgaggagugcagcugcuaccccaacgacgggaagguggagugccugugccgcgacaacuggaccggcacgaaccggcccgugcucgucaucagcccggaccuguccuaccgcgugggcuaccugugcgccgggcuccccagcgacacgccccggggcgaggacgcccaguucgugggguccugcaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcagauccggcgccaggucgugguggacaaccugaacugguccggcuacagcggcuccuucacgcugccggucgagcucagcgggcgcgagugccuggugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213807 - protein, 18 aa, Artificial Sequence
  signal peptide - HsALB
MKWVTFISLLFLFSSAYS

SEQ ID NO: 213808 - protein, 18 aa, Artificial Sequence
  signal peptide - IgE
MDWTWILFLVAAATRVHS

SEQ ID NO: 213809 - protein, 24 aa, Artificial Sequence
  signal peptide - HsCD5
MPMGSLQPLATLYLLGMLVASCLG

SEQ ID NO: 213810 - protein, 24 aa, Artificial Sequence
  signal peptide - HLA-A2-SP
MAVMAPRTLVLLLSGALALTQTWA

SEQ ID NO: 213811 - protein, 25 aa, Artificial Sequence
  signal peptide - HLA-A2-SP
MAVMAPRTLVLLLSGALALTQTWAG

SEQ ID NO: 213812 - protein, 24 aa, Artificial Sequence
  signal peptide - NgNep1
MASSLYSFLLALSIVYIFVAPTHS

SEQ ID NO: 213813 - protein, 19 aa, Artificial Sequence
  signal peptide - HsAzu1
MTRLTVLALLAGLLASSRA

SEQ ID NO: 213814 - protein, 16 aa, Artificial Sequence
  signal peptide - HsCD33
MPLLLLLPLLWAGALA

SEQ ID NO: 213815 - protein, 19 aa, Artificial Sequence
  signal peptide - VcCtxB
MIKLKFGVFFTVLLSSAYA

SEQ ID NO: 213816 - protein, 18 aa, Artificial Sequence
  signal peptide - HsCTRB2
MAFLWLLSCWALLGTTFG

SEQ ID NO: 213817 - protein, 17 aa, Artificial Sequence
  signal peptide - Gaussia princeps
MGVKVLFALICIAVAEA

SEQ ID NO: 213818 - protein, 17 aa, Artificial Sequence
  signal peptide - H1N1(Netherlands2009)-HA
MKAILVVLLYTFATANA

SEQ ID NO: 213819 - protein, 24 aa, Artificial Sequence
  signal peptide - HsIns-iso1
MALWMRLLPLLALLALWGPDPAAA

SEQ ID NO: 213820 - protein, 20 aa, Artificial Sequence
  signal peptide - HsIL2
MYRMQLLSCIALSLALVTNS

SEQ ID NO: 213821 - protein, 17 aa, Artificial Sequence
  signal peptide - HsSPARC
MRAWIFFLLCLAGRALA

SEQ ID NO: 213822 - protein, 23 aa, Artificial Sequence
  signal peptide - HsPLAT
MDAMKRGLCCVLLLCGAVFVSPS

SEQ ID NO: 213823 - protein, 21 aa, Artificial Sequence
  signal peptide - HsPLAT
MDAMKRGLCCVLLLCGAVFVS

SEQ ID NO: 213824 - protein, 22 aa, Artificial Sequence
  signal peptide - HsPLAT
MDAMKRGLCCVLLLCGAVFVSP

SEQ ID NO: 213825 - protein, 27 aa, Artificial Sequence
  signal peptide - HsEPO
MGVHECPAWLWLLLSLLSLPLGLPVLG

SEQ ID NO: 213826 - protein, 19 aa, Artificial Sequence
  signal peptide - immunoglobulin
MEFGLSWVFLVALFRGVQC

SEQ ID NO: 213827 - protein, 19 aa, Artificial Sequence
  signal peptide - immunoglobulin
MDWTWRVFCLLAVTPGAHP

SEQ ID NO: 213828 - protein, 19 aa, Artificial Sequence
  signal peptide - immunoglobulin
MAWSPLFLTLITHCAGSWA

SEQ ID NO: 213829 - protein, 21 aa, Artificial Sequence
  signal peptide - MmIgkappa
METDTLLLWVLLLWVPGSTGD

SEQ ID NO: 213830 - protein, 26 aa, Artificial Sequence
  signal peptide - NrChit1
MKTHYSSAILPILTLFVFLSINPSHG

SEQ ID NO: 213831 - protein, 21 aa, Artificial Sequence
  signal peptide - ClLp1.1
MGMRMMFIMFMLVVLATTVVS

SEQ ID NO: 213832 - protein, 20 aa, Artificial Sequence
  signal peptide - HsCST4
MARPLCTLLLLMATLAGALA

SEQ ID NO: 213833 - protein, 25 aa, Artificial Sequence
  signal peptide - MHCII
MAISGVPVLGFFIIAVLMSAQESWA

SEQ ID NO: 213834 - RNA, 54 nt, Artificial Sequence
  signal peptide - HsALB CDS wt
augaaguggguaaccuuuauuucccuucuuuuucucuuuagcucggcuuauucc

SEQ ID NO: 213835 - RNA, 54 nt, Artificial Sequence
  signal peptide - IgE CDS wt
auggacuggaccuggauccuguuccucguggccgccgcgacccgcguccacagc

SEQ ID NO: 213836 - RNA, 72 nt, Artificial Sequence
  signal peptide - HsCD5 CDS wt
augcccauggggucucugcaaccgcuggccaccuuguaccugcuggggaugcuggucgcuuccugccucgga

SEQ ID NO: 213837 - RNA, 72 nt, Artificial Sequence
  signal peptide - HLA-A2-SP CDS wt
auggccgucauggcgccccgaacccucguccugcuacucucgggggcucuggcccugacccagaccugggcg

SEQ ID NO: 213838 - RNA, 75 nt, Artificial Sequence
  signal peptide - HLA-A2-SP CDS wt
auggccgucauggcgccccgaacccucguccugcuacucucgggggcucuggcccugacccagaccugggcgggc

SEQ ID NO: 213839 - RNA, 72 nt, Artificial Sequence
  signal peptide - NgNep1 CDS wt
auggccucgucgcuguauucuuucuuacucgcauuaucgauaguuuacaucuuuguugccccaacacauucu

SEQ ID NO: 213840 - RNA, 57 nt, Artificial Sequence
  signal peptide - HsAzu1 CDS wt
augacccggcugacaguccuggcccugcuggcuggucugcuggcguccucgagggcc

SEQ ID NO: 213841 - RNA, 48 nt, Artificial Sequence
  signal peptide - HsCD33 CDS wt
augccgcugcugcuacugcugccccugcugugggcaggggcccuggcu

SEQ ID NO: 213842 - RNA, 57 nt, Artificial Sequence
  signal peptide - VcCtxB CDS wt
augauuaaauuaaaauuugguguuuuuuuuacaguuuuacuaucuucagcauaugca

SEQ ID NO: 213843 - RNA, 54 nt, Artificial Sequence
  signal peptide - HsCTRB2 CDS wt
auggcuuuccucuggcuccucuccugcugggcccuccuggguaccaccuucggc

SEQ ID NO: 213844 - RNA, 51 nt, Artificial Sequence
  signal peptide - Gaussia princeps CDS wt
augggagugaaaguucuuuuugcccuuauuuguauugcuguggccgaggcc

SEQ ID NO: 213845 - RNA, 51 nt, Artificial Sequence
  signal peptide - H1N1(Netherlands2009)-HA CDS wt
augaaggcaauacuaguaguucugcuauauacauuugcaaccgcaaaugca

SEQ ID NO: 213846 - RNA, 72 nt, Artificial Sequence
  signal peptide - HsIns-iso1 CDS wt
auggcccuguggaugcgccuccugccccugcuggcgcugcuggcccucuggggaccugacccagccgcagcc

SEQ ID NO: 213847 - RNA, 60 nt, Artificial Sequence
  signal peptide - HsIL2 CDS wt
auguacaggaugcaacuccugucuugcauugcacuaagucuugcacuugucacaaacagu

SEQ ID NO: 213848 - RNA, 51 nt, Artificial Sequence
  signal peptide - HsSPARC CDS wt
augagggccuggaucuucuuucuccuuugccuggccgggagggcucuggca

SEQ ID NO: 213849 - RNA, 69 nt, Artificial Sequence
  signal peptide - HsPLAT CDS wt
auggaugcaaugaagagagggcucugcugugugcugcugcuguguggagcagucuucguuucgcccagc

SEQ ID NO: 213850 - RNA, 63 nt, Artificial Sequence
  signal peptide - HsPLAT CDS wt
auggaugcaaugaagagagggcucugcugugugcugcugcuguguggagcagucuucguuucg

SEQ ID NO: 213851 - RNA, 66 nt, Artificial Sequence
  signal peptide - HsPLAT CDS wt
auggaugcaaugaagagagggcucugcugugugcugcugcuguguggagcagucuucguuucgccc

SEQ ID NO: 213852 - RNA, 81 nt, Artificial Sequence
  signal peptide - HsEPO CDS wt
augggggugcacgaauguccugccuggcuguggcuucuccugucccugcugucgcucccucugggccucccaguccugggc

SEQ ID NO: 213853 - RNA, 57 nt, Artificial Sequence
  signal peptide - immunoglobulin CDS wt
auggaguuugggcugagcuggguuuuccucguugcucuuuuuagagguguccagugu

SEQ ID NO: 213854 - RNA, 57 nt, Artificial Sequence
  signal peptide - immunoglobulin CDS wt
auggacuggaccuggagggucuucuguuugcuggcuguaacuccaggcgcccacccc

SEQ ID NO: 213855 - RNA, 57 nt, Artificial Sequence
  signal peptide - immunoglobulin CDS wt
auggccugguccccucucuuccucacccucaucacucacugugcaggguccugggcc

SEQ ID NO: 213856 - RNA, 63 nt, Artificial Sequence
  signal peptide - MmIgkappa CDS wt
auggagacagacacacuccugcuaugggugcugcugcucuggguuccagguuccacaggugac

SEQ ID NO: 213857 - RNA, 78 nt, Artificial Sequence
  signal peptide - NrChit1 CDS wt
augaagacccauuauucaucagcaauucucccgauccucacccucuucgucuuucucucgaucaauccaucccauggc

SEQ ID NO: 213858 - RNA, 63 nt, Artificial Sequence
  signal peptide - ClLp1.1 CDS wt
augggcaugcggaugauguucaucauguuuaugcugguugucuuggcaaccacugucguuucc

SEQ ID NO: 213859 - RNA, 60 nt, Artificial Sequence
  signal peptide - HsCST4 CDS wt
auggcccggccucuguguacccugcuacuccugauggcuacccuggcuggggcucuggcc

SEQ ID NO: 213860 - RNA, 75 nt, Artificial Sequence
  signal peptide - MHCII CDS wt
auggccauaaguggagucccugugcuaggauuuuucaucauagcugugcugaugagcgcucaggaaucaugggcu

SEQ ID NO: 213861 - RNA, 54 nt, Artificial Sequence
  signal peptide - HsALB CDS opt
augaagugggugaccuucaucagccugcucuuccuguucuccagcgccuacucc

SEQ ID NO: 213862 - RNA, 54 nt, Artificial Sequence; identical to SEQ ID NO: 213835
  signal peptide - IgE CDS opt

SEQ ID NO: 213863 - RNA, 72 nt, Artificial Sequence
  signal peptide - HsCD5 CDS opt
augcccaugggcagccugcagccgcucgccacccuguaccugcucgggaugcugguggccuccugccugggc

SEQ ID NO: 213864 - RNA, 72 nt, Artificial Sequence
  signal peptide - HLA-A2-SP CDS opt
auggccgugauggccccgcggacccugguccuccugcugagcggcgcgcucgcccugacccagacgugggcc

SEQ ID NO: 213865 - RNA, 75 nt, Artificial Sequence
  signal peptide - HLA-A2-SP CDS opt
auggccgugauggccccgcggacccugguccuccugcugagcggcgcgcucgcccugacccagacgugggccggg

SEQ ID NO: 213866 - RNA, 72 nt, Artificial Sequence
  signal peptide - NgNep1 CDS opt
auggccagcucccuguacagcuuccuccuggcccuguccaucguguacaucuucgucgcgcccacccacagc

SEQ ID NO: 213867 - RNA, 57 nt, Artificial Sequence
  signal peptide - HsAzu1 CDS opt
augacccgccugaccgugcucgcccugcuggccggccuccuggcgagcucccgggcc

SEQ ID NO: 213868 - RNA, 48 nt, Artificial Sequence
  signal peptide - HsCD33 CDS opt
augccccugcuccugcugcucccgcugcugugggccggcgcccucgcg

SEQ ID NO: 213869 - RNA, 57 nt, Artificial Sequence
  signal peptide - VcCtxB CDS opt
augaucaagcugaaguucggcguguucuucaccguccuccugagcuccgccuacgcc

SEQ ID NO: 213870 - RNA, 54 nt, Artificial Sequence
  signal peptide - HsCTRB2 CDS opt
auggccuuccuguggcuccugagcugcugggcccugcucggcaccaccuucggg

SEQ ID NO: 213871 - RNA, 51 nt, Artificial Sequence
  signal peptide - Gaussia princeps CDS opt
augggcgugaagguccuguucgcccucaucugcaucgccguggcggaggcc

SEQ ID NO: 213872 - RNA, 51 nt, Artificial Sequence
  signal peptide - H1N1(Netherlands2009)-HA CDS opt
augaaggccauccuggugguccuccuguacaccuucgccaccgcgaacgcc

SEQ ID NO: 213873 - RNA, 72 nt, Artificial Sequence
  signal peptide - HsIns-iso1 CDS opt
auggcccuguggaugcgccuccugccccugcucgcccugcuggcgcucuggggcccggaccccgccgccgcc

SEQ ID NO: 213874 - RNA, 60 nt, Artificial Sequence
  signal peptide - HsIL2 CDS opt
auguaccggaugcagcugcucagcugcaucgcccugucgcuggcgcucgugaccaacagc

SEQ ID NO: 213875 - RNA, 51 nt, Artificial Sequence
  signal peptide - HsSPARC CDS opt
augcgcgccuggaucuucuuccugcucugccuggccggccgggcccuggcc

SEQ ID NO: 213876 - RNA, 69 nt, Artificial Sequence
  signal peptide - HsPLAT CDS opt
auggacgccaugaagcgcggccugugcugcgugcuccugcugugcggggccgucuucgugagccccucc

SEQ ID NO: 213877 - RNA, 63 nt, Artificial Sequence
  signal peptide - HsPLAT CDS opt
auggacgccaugaagcgcggccugugcugcgugcuccugcugugcggggccgucuucgugagc

SEQ ID NO: 213878 - RNA, 66 nt, Artificial Sequence
  signal peptide - HsPLAT CDS opt
auggacgccaugaagcgcggccugugcugcgugcuccugcugugcggggccgucuucgugagcccc

SEQ ID NO: 213879 - RNA, 81 nt, Artificial Sequence
  signal peptide - HsEPO CDS opt
augggcgugcacgagugccccgccuggcuguggcuccugcugagccuccugucccugccgcucgggcugcccguccugggc

SEQ ID NO: 213880 - RNA, 57 nt, Artificial Sequence
  signal peptide - immunoglobulin CDS opt
auggaguucggccugagcuggguguuccucgucgcccuguuccgcggggugcagugc

SEQ ID NO: 213881 - RNA, 57 nt, Artificial Sequence
  signal peptide - immunoglobulin CDS opt
auggacuggaccuggcgcguguucugccugcucgccgucacccccggcgcccacccg

SEQ ID NO: 213882 - RNA, 57 nt, Artificial Sequence
  signal peptide - immunoglobulin CDS opt
auggccuggagcccccuguuccucacccugaucacccacugcgccggcuccugggcg

SEQ ID NO: 213883 - RNA, 63 nt, Artificial Sequence
  signal peptide - MmIgkappa CDS opt
auggagaccgacacccugcuccugugggugcugcuccuguggguccccggcagcacgggggac

SEQ ID NO: 213884 - RNA, 78 nt, Artificial Sequence
  signal peptide - NrChit1 CDS opt
augaagacccacuacagcuccgccauccugcccauccucacccuguucguguuccugagcaucaacccgucccacggc

SEQ ID NO: 213885 - RNA, 63 nt, Artificial Sequence
  signal peptide - ClLp1.1 CDS opt
augggcaugcgcaugauguucaucauguucaugcuggugguccucgccaccaccguggugagc

SEQ ID NO: 213886 - RNA, 60 nt, Artificial Sequence
  signal peptide - HsCST4 CDS opt
auggcccgcccccugugcacccuccugcugcucauggccacccuggcgggcgcccuggcc

SEQ ID NO: 213887 - RNA, 75 nt, Artificial Sequence
  signal peptide - MHCII CDS opt
auggccaucagcggcgugcccguccugggguucuucaucaucgccgugcucauguccgcgcaggagagcugggcc

SEQ ID NO: 213888 - RNA, 54 nt, Artificial Sequence
  signal peptide - HsALB CDS opt
augaagugggucaccuucaucucccuccucuuccucuucuccuccgccuacucc

SEQ ID NO: 213889 - RNA, 54 nt, Artificial Sequence
  signal peptide - IgE CDS opt
auggacuggaccuggauccucuuccucgucgccgccgccacccgcguccacucc

SEQ ID NO: 213890 - RNA, 72 nt, Artificial Sequence
  signal peptide - HsCD5 CDS opt
augcccaugggcucccuccagccccucgccacccucuaccuccucggcaugcucgucgccuccugccucggc

SEQ ID NO: 213891 - RNA, 72 nt, Artificial Sequence
  signal peptide - HLA-A2-SP CDS opt
auggccgucauggccccccgcacccucguccuccuccucuccggcgcccucgcccucacccagaccugggcc

SEQ ID NO: 213892 - RNA, 75 nt, Artificial Sequence
  signal peptide - HLA-A2-SP CDS opt
auggccgucauggccccccgcacccucguccuccuccucuccggcgcccucgcccucacccagaccugggccggc

SEQ ID NO: 213893 - RNA, 72 nt, Artificial Sequence
  signal peptide - NgNep1 CDS opt
auggccuccucccucuacuccuuccuccucgcccucuccaucgucuacaucuucgucgcccccacccacucc

SEQ ID NO: 213894 - RNA, 57 nt, Artificial Sequence
  signal peptide - HsAzu1 CDS opt
augacccgccucaccguccucgcccuccucgccggccuccucgccuccucccgcgcc

SEQ ID NO: 213895 - RNA, 48 nt, Artificial Sequence
  signal peptide - HsCD33 CDS opt
augccccuccuccuccuccucccccuccucugggccggcgcccucgcc

SEQ ID NO: 213896 - RNA, 57 nt, Artificial Sequence
  signal peptide - VcCtxB CDS opt
augaucaagcucaaguucggcgucuucuucaccguccuccucuccuccgccuacgcc

SEQ ID NO: 213897 - RNA, 54 nt, Artificial Sequence
  signal peptide - HsCTRB2 CDS opt
auggccuuccucuggcuccucuccugcugggcccuccucggcaccaccuucggc

SEQ ID NO: 213898 - RNA, 51 nt, Artificial Sequence
  signal peptide - Gaussia princeps CDS opt
augggcgucaagguccucuucgcccucaucugcaucgccgucgccgaggcc

SEQ ID NO: 213899 - RNA, 51 nt, Artificial Sequence
  signal peptide - H1N1(Netherlands2009)-HA CDS opt
augaaggccauccucgucguccuccucuacaccuucgccaccgccaacgcc

SEQ ID NO: 213900 - RNA, 72 nt, Artificial Sequence
  signal peptide - HsIns-iso1 CDS opt
auggcccucuggaugcgccuccucccccuccucgcccuccucgcccucuggggccccgaccccgccgccgcc

SEQ ID NO: 213901 - RNA, 60 nt, Artificial Sequence
  signal peptide - HsIL2 CDS opt
auguaccgcaugcagcuccucuccugcaucgcccucucccucgcccucgucaccaacucc

SEQ ID NO: 213902 - RNA, 51 nt, Artificial Sequence
  signal peptide - HsSPARC CDS opt
augcgcgccuggaucuucuuccuccucugccucgccggccgcgcccucgcc

SEQ ID NO: 213903 - RNA, 69 nt, Artificial Sequence
  signal peptide - HsPLAT CDS opt
auggacgccaugaagcgcggccucugcugcguccuccuccucugcggcgccgucuucgucucccccucc

SEQ ID NO: 213904 - RNA, 63 nt, Artificial Sequence
  signal peptide - HsPLAT CDS opt
auggacgccaugaagcgcggccucugcugcguccuccuccucugcggcgccgucuucgucucc

SEQ ID NO: 213905 - RNA, 66 nt, Artificial Sequence
  signal peptide - HsPLAT CDS opt
auggacgccaugaagcgcggccucugcugcguccuccuccucugcggcgccgucuucgucuccccc

SEQ ID NO: 213906 - RNA, 81 nt, Artificial Sequence
  signal peptide - HsEPO CDS opt
augggcguccacgagugccccgccuggcucuggcuccuccucucccuccucucccucccccucggccuccccguccucggc

SEQ ID NO: 213907 - RNA, 57 nt, Artificial Sequence
  signal peptide - immunoglobulin CDS opt
auggaguucggccucuccugggucuuccucgucgcccucuuccgcggcguccagugc

SEQ ID NO: 213908 - RNA, 57 nt, Artificial Sequence
  signal peptide - immunoglobulin CDS opt
auggacuggaccuggcgcgucuucugccuccucgccgucacccccggcgcccacccc

SEQ ID NO: 213909 - RNA, 57 nt, Artificial Sequence
  signal peptide - immunoglobulin CDS opt
auggccugguccccccucuuccucacccucaucacccacugcgccggcuccugggcc

SEQ ID NO: 213910 - RNA, 63 nt, Artificial Sequence
  signal peptide - MmIgkappa CDS opt
auggagaccgacacccuccuccucuggguccuccuccucuggguccccggcuccaccggcgac

SEQ ID NO: 213911 - RNA, 78 nt, Artificial Sequence
  signal peptide - NrChit1 CDS opt
augaagacccacuacuccuccgccauccuccccauccucacccucuucgucuuccucuccaucaaccccucccacggc

SEQ ID NO: 213912 - RNA, 63 nt, Artificial Sequence
  signal peptide - ClLp1.1 CDS opt
augggcaugcgcaugauguucaucauguucaugcucgucguccucgccaccaccgucgucucc

SEQ ID NO: 213913 - RNA, 60 nt, Artificial Sequence
  signal peptide - HsCST4 CDS opt
auggcccgcccccucugcacccuccuccuccucauggccacccucgccggcgcccucgcc

SEQ ID NO: 213914 - RNA, 75 nt, Artificial Sequence
  signal peptide - MHCII CDS opt
auggccaucuccggcguccccguccucggcuucuucaucaucgccguccucauguccgcccaggaguccugggcc

SEQ ID NO: 213915 - RNA, 54 nt, Artificial Sequence
  signal peptide - HsALB CDS opt
augaagugggugaccuucaucagccugcucuuucuuuucuccucugccuacuca

SEQ ID NO: 213916 - RNA, 54 nt, Artificial Sequence
  signal peptide - IgE CDS opt
auggacuggaccuggauccuguuccucguggccgcugcaacaagaguccacagc

SEQ ID NO: 213917 - RNA, 72 nt, Artificial Sequence
  signal peptide - HsCD5 CDS opt
augcccaugggcagccugcagccucucgccacccuuuaccuguuggggauguuaguggcuuccugccuggga

SEQ ID NO: 213918 - RNA, 72 nt, Artificial Sequence
  signal peptide - HLA-A2-SP CDS opt
auggccgugauggcucccagaacccugguccuccuucugagcggcgcauuggccuuaacacagacuugggcg

SEQ ID NO: 213919 - RNA, 75 nt, Artificial Sequence
  signal peptide - HLA-A2-SP CDS opt
auggccgugauggcucccagaacccugguccuccuucugagcggcgcauuggccuuaacacagacuugggcgggg

SEQ ID NO: 213920 - RNA, 72 nt, Artificial Sequence
  signal peptide - NgNep1 CDS opt
auggccagcucccuguacucuuuccuccuugcucugucaaucguguauauuuuugucgcacccacccacagu

SEQ ID NO: 213921 - RNA, 57 nt, Artificial Sequence
  signal peptide - HsAzu1 CDS opt
augaccagacugacagugcucgcccuucuggcuggcuuguuagcaagcuccagggcc

SEQ ID NO: 213922 - RNA, 48 nt, Artificial Sequence
  signal peptide - HsCD33 CDS opt
augccccugcuccuucuguugccuuuacugugggccggcgcucuagca

SEQ ID NO: 213923 - RNA, 57 nt, Artificial Sequence
  signal peptide - VcCtxB CDS opt
augaucaagcugaaauucggcguguuuuucaccguccuccuuagcuccgccuacgcu

SEQ ID NO: 213924 - RNA, 54 nt, Artificial Sequence
  signal peptide - HsCTRB2 CDS opt
auggccuuccuguggcuccuuagcugcugggcucuguugggcaccacauuuggg

SEQ ID NO: 213925 - RNA, 51 nt, Artificial Sequence
  signal peptide - Gaussia princeps CDS opt
augggcgugaagguccuguucgcccucaucugcauugcuguugcagaggcc

SEQ ID NO: 213926 - RNA, 51 nt, Artificial Sequence
  signal peptide - H1N1(Netherlands2009)-HA CDS opt
augaaggccauccuggugguccuccuuuacaccuucgcuacagcaaacgcc

SEQ ID NO: 213927 - RNA, 72 nt, Artificial Sequence
  signal peptide - HsIns-iso1 CDS opt
auggcccuguggaugagacuccuuccccuguuggcuuuacuggcacuauggggcccugacccagccgcggcu

SEQ ID NO: 213928 - RNA, 60 nt, Artificial Sequence
  signal peptide - HsIL2 CDS opt
auguacagaaugcagcugcucagcugcaucgcccuuucccuggcuuuggugaccaacucu

SEQ ID NO: 213929 - RNA, 51 nt, Artificial Sequence
  signal peptide - HsSPARC CDS opt
augagagccuggaucuucuuucugcucugccuugcuggcagggcacuggcc

SEQ ID NO: 213930 - RNA, 69 nt, Artificial Sequence
  signal peptide - HsPLAT CDS opt
auggacgccaugaagagaggccugugcugugugcuccuucugugcggggcugucuucguuagccccucc

SEQ ID NO: 213931 - RNA, 63 nt, Artificial Sequence
  signal peptide - HsPLAT CDS opt
auggacgccaugaagagaggccugugcugugugcuccuucugugcggggcugucuucguuagc

SEQ ID NO: 213932 - RNA, 66 nt, Artificial Sequence
  signal peptide - HsPLAT CDS opt
auggacgccaugaagagaggccugugcugugugcuccuucugugcggggcugucuucguuagcccc

SEQ ID NO: 213933 - RNA, 81 nt, Artificial Sequence
  signal peptide - HsEPO CDS opt
augggcgugcacgagugccccgccuggcuguggcuccuucugagcuuguuaucccugccucuagggcucccaguccuggga

SEQ ID NO: 213934 - RNA, 57 nt, Artificial Sequence
  signal peptide - immunoglobulin CDS opt
auggaguucggccugagcuggguguuucucgucgcccuuuucagagggguucagugc

SEQ ID NO: 213935 - RNA, 57 nt, Artificial Sequence
  signal peptide - immunoglobulin CDS opt
auggacuggaccuggagaguguucugccugcucgccgucacacccggcgcucacccu

SEQ ID NO: 213936 - RNA, 57 nt, Artificial Sequence
  signal peptide - immunoglobulin CDS opt
auggccuggagcccccuguuccucacccuuaucacacacugcgcuggcuccugggca

SEQ ID NO: 213937 - RNA, 63 nt, Artificial Sequence
  signal peptide - MmIgkappa CDS opt
auggagaccgacacacugcuccuuugggugcuguuguuauggguccccggcagcacuggggau

SEQ ID NO: 213938 - RNA, 78 nt, Artificial Sequence
  signal peptide - NrChit1 CDS opt
augaagacccacuacagcuccgccauccugcccauucucacacuuuucguguuucugucuauaaacccuucacauggc

SEQ ID NO: 213939 - RNA, 63 nt, Artificial Sequence
  signal peptide - ClLp1.1 CDS opt
augggcaugagaaugauguucaucauguuuaugcuggugguccucgccaccacaguugugagc

SEQ ID NO: 213940 - RNA, 60 nt, Artificial Sequence
  signal peptide - HsCST4 CDS opt
auggccagaccccugugcacccuccuucuguugauggcuacauuagcaggcgcccuggcg

SEQ ID NO: 213941 - RNA, 75 nt, Artificial Sequence
  signal peptide - MHCII CDS opt
auggccaucagcggcgugcccguccugggguucuuuauuauagcuguucucauguccgcacaggagucuugggcc

SEQ ID NO: 213942 - RNA, 54 nt, Artificial Sequence
  signal peptide - HsALB CDS opt
augaagugggugaccuucaucagccugcuguuccuguucagcagcgccuacagc

SEQ ID NO: 213943 - RNA, 54 nt, Artificial Sequence
  signal peptide - IgE CDS opt
auggacuggaccuggauccuguuccugguggccgccgccaccagagugcacagc

SEQ ID NO: 213944 - RNA, 72 nt, Artificial Sequence
  signal peptide - HsCD5 CDS opt
augcccaugggcagccugcagccccuggccacccuguaccugcugggcaugcugguggccagcugccugggc

SEQ ID NO: 213945 - RNA, 72 nt, Artificial Sequence
  signal peptide - HLA-A2-SP CDS opt
auggccgugauggcccccagaacccuggugcugcugcugagcggcgcccuggcccugacccagaccugggcc

SEQ ID NO: 213946 - RNA, 75 nt, Artificial Sequence
  signal peptide - HLA-A2-SP CDS opt
auggccgugauggcccccagaacccuggugcugcugcugagcggcgcccuggcccugacccagaccugggccggc

SEQ ID NO: 213947 - RNA, 72 nt, Artificial Sequence
  signal peptide - NgNep1 CDS opt
auggccagcagccuguacagcuuccugcuggcccugagcaucguguacaucuucguggcccccacccacagc

SEQ ID NO: 213948 - RNA, 57 nt, Artificial Sequence
  signal peptide - HsAzu1 CDS opt
augaccagacugaccgugcuggcccugcuggccggccugcuggccagcagcagagcc

SEQ ID NO: 213949 - RNA, 48 nt, Artificial Sequence
  signal peptide - HsCD33 CDS opt
augccccugcugcugcugcugccccugcugugggccggcgcccuggcc

SEQ ID NO: 213950 - RNA, 57 nt, Artificial Sequence
  signal peptide - VcCtxB CDS opt
augaucaagcugaaguucggcguguucuucaccgugcugcugagcagcgccuacgcc

SEQ ID NO: 213951 - RNA, 54 nt, Artificial Sequence
  signal peptide - HsCTRB2 CDS opt
auggccuuccuguggcugcugagcugcugggcccugcugggcaccaccuucggc

SEQ ID NO: 213952 - RNA, 51 nt, Artificial Sequence
  signal peptide - Gaussia princeps CDS opt
augggcgugaaggugcuguucgcccugaucugcaucgccguggccgaggcc

SEQ ID NO: 213953 - RNA, 51 nt, Artificial Sequence
  signal peptide - H1N1(Netherlands2009)-HA CDS opt
augaaggccauccugguggugcugcuguacaccuucgccaccgccaacgcc

SEQ ID NO: 213954 - RNA, 72 nt, Artificial Sequence
  signal peptide - HsIns-iso1 CDS opt
auggcccuguggaugagacugcugccccugcuggcccugcuggcccuguggggccccgaccccgccgccgcc

SEQ ID NO: 213955 - RNA, 60 nt, Artificial Sequence
  signal peptide - HsIL2 CDS opt
auguacagaaugcagcugcugagcugcaucgcccugagccuggcccuggugaccaacagc

SEQ ID NO: 213956 - RNA, 51 nt, Artificial Sequence
  signal peptide - HsSPARC CDS opt
augagagccuggaucuucuuccugcugugccuggccggcagagcccuggcc

SEQ ID NO: 213957 - RNA, 69 nt, Artificial Sequence
  signal peptide - HsPLAT CDS opt
auggacgccaugaagagaggccugugcugcgugcugcugcugugcggcgccguguucgugagccccagc

SEQ ID NO: 213958 - RNA, 63 nt, Artificial Sequence
  signal peptide - HsPLAT CDS opt
auggacgccaugaagagaggccugugcugcgugcugcugcugugcggcgccguguucgugagc

SEQ ID NO: 213959 - RNA, 66 nt, Artificial Sequence
  signal peptide - HsPLAT CDS opt
auggacgccaugaagagaggccugugcugcgugcugcugcugugcggcgccguguucgugagcccc

SEQ ID NO: 213960 - RNA, 81 nt, Artificial Sequence
  signal peptide - HsEPO CDS opt
augggcgugcacgagugccccgccuggcuguggcugcugcugagccugcugagccugccccugggccugcccgugcugggc

SEQ ID NO: 213961 - RNA, 57 nt, Artificial Sequence
  signal peptide - immunoglobulin CDS opt
auggaguucggccugagcuggguguuccugguggcccuguucagaggcgugcagugc

SEQ ID NO: 213962 - RNA, 57 nt, Artificial Sequence
  signal peptide - immunoglobulin CDS opt
auggacuggaccuggagaguguucugccugcuggccgugacccccggcgcccacccc

SEQ ID NO: 213963 - RNA, 57 nt, Artificial Sequence
  signal peptide - immunoglobulin CDS opt
auggccuggagcccccuguuccugacccugaucacccacugcgccggcagcugggcc

SEQ ID NO: 213964 - RNA, 63 nt, Artificial Sequence
  signal peptide - MmIgkappa CDS opt
auggagaccgacacccugcugcugugggugcugcugcugugggugcccggcagcaccggcgac

SEQ ID NO: 213965 - RNA, 78 nt, Artificial Sequence
  signal peptide - NrChit1 CDS opt
augaagacccacuacagcagcgccauccugcccauccugacccuguucguguuccugagcaucaaccccagccacggc

SEQ ID NO: 213966 - RNA, 63 nt, Artificial Sequence
  signal peptide - ClLp1.1 CDS opt
augggcaugagaaugauguucaucauguucaugcugguggugcuggccaccaccguggugagc

SEQ ID NO: 213967 - RNA, 60 nt, Artificial Sequence
  signal peptide - HsCST4 CDS opt
auggccagaccccugugcacccugcugcugcugauggccacccuggccggcgcccuggcc

SEQ ID NO: 213968 - RNA, 75 nt, Artificial Sequence
  signal peptide - MHCII CDS opt
auggccaucagcggcgugcccgugcugggcuucuucaucaucgccgugcugaugagcgcccaggagagcugggcc

SEQ ID NO: 213969 - RNA, 54 nt, Artificial Sequence
  signal peptide - HsALB CDS opt
augaagugggugaccuucaucagccugcucuuucuguucuccucugccuacagc

SEQ ID NO: 213970 - RNA, 54 nt, Artificial Sequence
  signal peptide - IgE CDS opt
auggacuggaccuggauccuguuccucguggccgcugccacaagaguccacagc

SEQ ID NO: 213971 - RNA, 72 nt, Artificial Sequence
  signal peptide - HsCD5 CDS opt
augcccaugggcagccugcagccucucgccacccuguaccuucuggggaugcucguggcuuccugccuggga

SEQ ID NO: 213972 - RNA, 72 nt, Artificial Sequence
  signal peptide - HLA-A2-SP CDS opt
auggccgugauggcucccagaacccugguccuccugcuuagcggcgcccuggcgcucacacagacgugggcu

SEQ ID NO: 213973 - RNA, 75 nt, Artificial Sequence
  signal peptide - HLA-A2-SP CDS opt
auggccgugauggcucccagaacccugguccuccugcuuagcggcgcccuggcgcucacacagacgugggcuggg

SEQ ID NO: 213974 - RNA, 72 nt, Artificial Sequence
  signal peptide - NgNep1 CDS opt
auggccagcucccuguacucuuuccuccuggcucuuagcaucguguauauuuuugucgcccccacccacucc

SEQ ID NO: 213975 - RNA, 57 nt, Artificial Sequence
  signal peptide - HsAzu1 CDS opt
augaccagacugacagugcucgcccugcuugcuggccugcucgccagcucccgggcg

SEQ ID NO: 213976 - RNA, 48 nt, Artificial Sequence
  signal peptide - HsCD33 CDS opt
augccccugcuccugcuucugccucuccugugggccggcgcucuugcc

SEQ ID NO: 213977 - RNA, 57 nt, Artificial Sequence
  signal peptide - VcCtxB CDS opt
augaucaagcugaaauucggcguguuuuucaccguccuccugagcuccgccuacgcu

SEQ ID NO: 213978 - RNA, 54 nt, Artificial Sequence
  signal peptide - HsCTRB2 CDS opt
auggcuuuccuguggcuccugagcugcugggcccuucugggcaccacauuuggg

SEQ ID NO: 213979 - RNA, 51 nt, Artificial Sequence
  signal peptide - Gaussia princeps CDS opt
augggcgugaagguccuguucgcccucaucugcauugcuguugccgaggcg

SEQ ID NO: 213980 - RNA, 51 nt, Artificial Sequence
  signal peptide - H1N1(Netherlands2009)-HA CDS opt
augaaggccauccuggugguccuccuguacaccuucgcuacagccaacgcg

SEQ ID NO: 213981 - RNA, 72 nt, Artificial Sequence
  signal peptide - HsIns-iso1 CDS opt
auggcccuguggaugagacuccugccccuucuggcucuccuggcccuuuggggcccugacccggcggcugcc

SEQ ID NO: 213982 - RNA, 60 nt, Artificial Sequence
  signal peptide - HsIL2 CDS opt
auguacagaaugcagcugcucagcugcaucgcccugucccuugcucuggugaccaacucu

SEQ ID NO: 213983 - RNA, 51 nt, Artificial Sequence
  signal peptide - HsSPARC CDS opt
augagagccuggaucuucuuucugcucugccuggcuggccgggcccuugcg

SEQ ID NO: 213984 - RNA, 69 nt, Artificial Sequence
  signal peptide - HsPLAT CDS opt
auggacgccaugaagagaggccugugcugugugcuccugcuuugcggggcugucuucguuagccccucc

SEQ ID NO: 213985 - RNA, 63 nt, Artificial Sequence
  signal peptide - HsPLAT CDS opt
auggacgccaugaagagaggccugugcugugugcuccugcuuugcggggcugucuucguuagc

SEQ ID NO: 213986 - RNA, 66 nt, Artificial Sequence
  signal peptide - HsPLAT CDS opt
auggacgccaugaagagaggccugugcugugugcuccugcuuugcggggcugucuucguuagcccc

SEQ ID NO: 213987 - RNA, 81 nt, Artificial Sequence
  signal peptide - HsEPO CDS opt
augggcgugcacgagugccccgccuggcuguggcuccugcuuagccugcucucccugccucuugggcugccgguccucgga

SEQ ID NO: 213988 - RNA, 57 nt, Artificial Sequence
  signal peptide - immunoglobulin CDS opt
auggaguucggccugagcuggguguuucucgucgcccuguucagagggguucagugc

SEQ ID NO: 213989 - RNA, 57 nt, Artificial Sequence; identical to SEQ ID NO: 213935
  signal peptide - immunoglobulin CDS opt

SEQ ID NO: 213990 - RNA, 57 nt, Artificial Sequence
  signal peptide - immunoglobulin CDS opt
auggccuggagcccccuguuccucacccugaucacacacugcgcuggcuccugggcc

SEQ ID NO: 213991 - RNA, 63 nt, Artificial Sequence
  signal peptide - MmIgkappa CDS opt
auggagaccgacacacugcuccugugggugcuucugcucuggguccccggcagcacgggggau

SEQ ID NO: 213992 - RNA, 78 nt, Artificial Sequence
  signal peptide - NrChit1 CDS opt
augaagacccacuacagcuccgccauccugcccauucucacacuguucguguuucuuucuaucaacccuagccauggc

SEQ ID NO: 213993 - RNA, 63 nt, Artificial Sequence; identical to SEQ ID NO: 213939
  signal peptide - ClLp1.1 CDS opt

SEQ ID NO: 213994 - RNA, 60 nt, Artificial Sequence
  signal peptide - HsCST4 CDS opt
auggccagaccccugugcacccuccugcuucugauggcuacacucgccggcgcgcuggcu

SEQ ID NO: 213995 - RNA, 75 nt, Artificial Sequence
  signal peptide - MHCII CDS opt
auggccaucagcggcgugcccguccugggguucuuuauuaucgcuguucucauguccgcccaggagucuugggcg

SEQ ID NO: 213996 - protein, 567 aa, Artificial Sequence
  derived and/or modified sequence from Influenza A H1N1 hemagglutinin
MKWVTFISLLFLFSSAYSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 213997 - protein, 567 aa, Artificial Sequence
  derived and/or modified sequence from Influenza A H1N1 hemagglutinin
MDWTWILFLVAAATRVHSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 213998 - protein, 573 aa, Artificial Sequence
  derived and/or modified sequence from Influenza A H1N1 hemagglutinin
MPMGSLQPLATLYLLGMLVASCLGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 213999 - protein, 573 aa, Artificial Sequence
  derived and/or modified sequence from Influenza A H1N1 hemagglutinin
MAVMAPRTLVLLLSGALALTQTWADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214000 - protein, 574 aa, Artificial Sequence
  derived and/or modified sequence from Influenza A H1N1 hemagglutinin
MAVMAPRTLVLLLSGALALTQTWAGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214001 - protein, 573 aa, Artificial Sequence
  derived and/or modified sequence from Influenza A H1N1 hemagglutinin
MASSLYSFLLALSIVYIFVAPTHSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214002 - protein, 568 aa, Artificial Sequence
  derived and/or modified sequence from Influenza A H1N1 hemagglutinin
MTRLTVLALLAGLLASSRADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214003 - protein, 565 aa, Artificial Sequence
  derived and/or modified sequence from Influenza A H1N1 hemagglutinin
MPLLLLLPLLWAGALADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214004 - protein, 568 aa, Artificial Sequence
  derived and/or modified sequence from Influenza A H1N1 hemagglutinin
MIKLKFGVFFTVLLSSAYADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214005 - protein, 567 aa, Artificial Sequence
  derived and/or modified sequence from Influenza A H1N1 hemagglutinin
MAFLWLLSCWALLGTTFGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214006 - protein, 566 aa, Artificial Sequence
  derived and/or modified sequence from Influenza A H1N1 hemagglutinin
MGVKVLFALICIAVAEADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214007 - protein, 566 aa, Artificial Sequence; identical to SEQ ID NO: 214006
  derived and/or modified sequence from Influenza A H1N1 hemagglutinin

SEQ ID NO: 214008 - protein, 566 aa, Artificial Sequence; identical to SEQ ID NO: 9150
  derived and/or modified sequence from Influenza A H1N1 hemagglutinin

SEQ ID NO: 214009 - protein, 573 aa, Artificial Sequence
  derived and/or modified sequence from Influenza A H1N1 hemagglutinin
MALWMRLLPLLALLALWGPDPAAADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214010 - protein, 569 aa, Artificial Sequence
  derived and/or modified sequence from Influenza A H1N1 hemagglutinin
MYRMQLLSCIALSLALVTNSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214011 - protein, 566 aa, Artificial Sequence
  derived and/or modified sequence from Influenza A H1N1 hemagglutinin
MRAWIFFLLCLAGRALADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214012 - protein, 572 aa, Artificial Sequence
  derived and/or modified sequence from Influenza A H1N1 hemagglutinin
MDAMKRGLCCVLLLCGAVFVSPSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214013 - protein, 570 aa, Artificial Sequence
  derived and/or modified sequence from Influenza A H1N1 hemagglutinin
MDAMKRGLCCVLLLCGAVFVSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214014 - protein, 571 aa, Artificial Sequence
  derived and/or modified sequence from Influenza A H1N1 hemagglutinin
MDAMKRGLCCVLLLCGAVFVSPDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214015 - protein, 576 aa, Artificial Sequence
  derived and/or modified sequence from Influenza A H1N1 hemagglutinin
MGVHECPAWLWLLLSLLSLPLGLPVLGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214016 - protein, 568 aa, Artificial Sequence
  derived and/or modified sequence from Influenza A H1N1 hemagglutinin
MEFGLSWVFLVALFRGVQCDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214017 - protein, 568 aa, Artificial Sequence
  derived and/or modified sequence from Influenza A H1N1 hemagglutinin
MDWTWRVFCLLAVTPGAHPDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214018 - protein, 568 aa, Artificial Sequence
  derived and/or modified sequence from Influenza A H1N1 hemagglutinin
MAWSPLFLTLITHCAGSWADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214019 - protein, 570 aa, Artificial Sequence
  derived and/or modified sequence from Influenza A H1N1 hemagglutinin
METDTLLLWVLLLWVPGSTGDDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214020 - protein, 575 aa, Artificial Sequence
  derived and/or modified sequence from Influenza A H1N1 hemagglutinin
MKTHYSSAILPILTLFVFLSINPSHGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214021 - protein, 570 aa, Artificial Sequence
  derived and/or modified sequence from Influenza A H1N1 hemagglutinin
MGMRMMFIMFMLVVLATTVVSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214022 - protein, 569 aa, Artificial Sequence
  derived and/or modified sequence from Influenza A H1N1 hemagglutinin
MARPLCTLLLLMATLAGALADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214023 - protein, 574 aa, Artificial Sequence
  derived and/or modified sequence from Influenza A H1N1 hemagglutinin
MAISGVPVLGFFIIAVLMSAQESWADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214024 - RNA, 1704 nt, Artificial Sequence
  derived and/or modified sequence opt from Influenza A H1N1 hemagglutinin
augaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214025 - RNA, 1704 nt, Artificial Sequence
  derived and/or modified sequence opt from Influenza A H1N1 hemagglutinin
auggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214026 - RNA, 1722 nt, Artificial Sequence
  derived and/or modified sequence opt from Influenza A H1N1 hemagglutinin
augcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214027 - RNA, 1722 nt, Artificial Sequence
  derived and/or modified sequence opt from Influenza A H1N1 hemagglutinin
auggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214028 - RNA, 1725 nt, Artificial Sequence
  derived and/or modified sequence opt from Influenza A H1N1 hemagglutinin
auggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214029 - RNA, 1722 nt, Artificial Sequence
  derived and/or modified sequence opt from Influenza A H1N1 hemagglutinin
auggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214030 - RNA, 1707 nt, Artificial Sequence
  derived and/or modified sequence opt from Influenza A H1N1 hemagglutinin
augacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214031 - RNA, 1698 nt, Artificial Sequence
  derived and/or modified sequence opt from Influenza A H1N1 hemagglutinin
augccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214032 - RNA, 1707 nt, Artificial Sequence
  derived and/or modified sequence opt from Influenza A H1N1 hemagglutinin
augaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214033 - RNA, 1704 nt, Artificial Sequence
  derived and/or modified sequence opt from Influenza A H1N1 hemagglutinin
auggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214034 - RNA, 1701 nt, Artificial Sequence
  derived and/or modified sequence opt from Influenza A H1N1 hemagglutinin
augggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214035 - RNA, 1701 nt, Artificial Sequence
  derived and/or modified sequence opt from Influenza A H1N1 hemagglutinin
augggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214036 - RNA, 1701 nt, Artificial Sequence; identical to SEQ ID NO: 213530
  derived and/or modified sequence opt from Influenza A H1N1 hemagglutinin

SEQ ID NO: 214037 - RNA, 1722 nt, Artificial Sequence
  derived and/or modified sequence opt from Influenza A H1N1 hemagglutinin
auggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214038 - RNA, 1710 nt, Artificial Sequence
  derived and/or modified sequence opt from Influenza A H1N1 hemagglutinin
auguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214039 - RNA, 1701 nt, Artificial Sequence
  derived and/or modified sequence opt from Influenza A H1N1 hemagglutinin
augcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214040 - RNA, 1719 nt, Artificial Sequence
  derived and/or modified sequence opt from Influenza A H1N1 hemagglutinin
auggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214041 - RNA, 1713 nt, Artificial Sequence
  derived and/or modified sequence opt from Influenza A H1N1 hemagglutinin
auggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214042 - RNA, 1716 nt, Artificial Sequence
  derived and/or modified sequence opt from Influenza A H1N1 hemagglutinin
auggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214043 - RNA, 1731 nt, Artificial Sequence
  derived and/or modified sequence opt from Influenza A H1N1 hemagglutinin
augggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214044 - RNA, 1707 nt, Artificial Sequence
  derived and/or modified sequence opt from Influenza A H1N1 hemagglutinin
auggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214045 - RNA, 1707 nt, Artificial Sequence
  derived and/or modified sequence opt from Influenza A H1N1 hemagglutinin
auggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214046 - RNA, 1707 nt, Artificial Sequence
  derived and/or modified sequence opt from Influenza A H1N1 hemagglutinin
auggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214047 - RNA, 1713 nt, Artificial Sequence
  derived and/or modified sequence opt from Influenza A H1N1 hemagglutinin
auggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214048 - RNA, 1728 nt, Artificial Sequence
  derived and/or modified sequence opt from Influenza A H1N1 hemagglutinin
augaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214049 - RNA, 1713 nt, Artificial Sequence
  derived and/or modified sequence opt from Influenza A H1N1 hemagglutinin
augggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214050 - RNA, 1710 nt, Artificial Sequence
  derived and/or modified sequence opt from Influenza A H1N1 hemagglutinin
auggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214051 - RNA, 1725 nt, Artificial Sequence
  derived and/or modified sequence opt from Influenza A H1N1 hemagglutinin
auggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214052 - RNA, 1942 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214053 - RNA, 1939 nt, Artificial Sequence
  mRNA product opt Design1 from Influenza A H1N1 hemagglutinin
gggagaaagcuuaccauggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214054 - RNA, 1924 nt, Artificial Sequence
  mRNA product opt Design1 from Influenza A H1N1 hemagglutinin
gggagaaagcuuaccaugacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214055 - RNA, 1915 nt, Artificial Sequence
  mRNA product opt Design1 from Influenza A H1N1 hemagglutinin
gggagaaagcuuaccaugccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214056 - RNA, 1924 nt, Artificial Sequence
  mRNA product opt Design1 from Influenza A H1N1 hemagglutinin
gggagaaagcuuaccaugaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214057 - RNA, 1921 nt, Artificial Sequence
  mRNA product opt Design1 from Influenza A H1N1 hemagglutinin
gggagaaagcuuaccauggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214058 - RNA, 1918 nt, Artificial Sequence
  mRNA product opt Design1 from Influenza A H1N1 hemagglutinin
gggagaaagcuuaccaugggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214059 - RNA, 1918 nt, Artificial Sequence
  mRNA product opt Design1 from Influenza A H1N1 hemagglutinin
gggagaaagcuuaccaugggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214060 - RNA, 1918 nt, Artificial Sequence; identical to SEQ ID NO: 213561
  mRNA product opt Design1 from Influenza A H1N1 hemagglutinin

SEQ ID NO: 214061 - RNA, 1939 nt, Artificial Sequence
  mRNA product opt Design1 from Influenza A H1N1 hemagglutinin
gggagaaagcuuaccauggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214062 - RNA, 1927 nt, Artificial Sequence
  mRNA product opt Design1 from Influenza A H1N1 hemagglutinin
gggagaaagcuuaccauguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214063 - RNA, 1918 nt, Artificial Sequence
  mRNA product opt Design1 from Influenza A H1N1 hemagglutinin
gggagaaagcuuaccaugcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214064 - RNA, 1936 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214065 - RNA, 1930 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214066 - RNA, 1933 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214067 - RNA, 1948 nt, Artificial Sequence
  mRNA product opt Design1 from Influenza A H1N1 hemagglutinin
gggagaaagcuuaccaugggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214068 - RNA, 1924 nt, Artificial Sequence
  mRNA product opt Design1 from Influenza A H1N1 hemagglutinin
gggagaaagcuuaccauggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214069 - RNA, 1924 nt, Artificial Sequence
  mRNA product opt Design1 from Influenza A H1N1 hemagglutinin
gggagaaagcuuaccauggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214070 - RNA, 1924 nt, Artificial Sequence
  mRNA product opt Design1 from Influenza A H1N1 hemagglutinin
gggagaaagcuuaccauggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214071 - RNA, 1930 nt, Artificial Sequence
  mRNA product opt Design1 from Influenza A H1N1 hemagglutinin
gggagaaagcuuaccauggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214072 - RNA, 1945 nt, Artificial Sequence
  mRNA product opt Design1 from Influenza A H1N1 hemagglutinin
gggagaaagcuuaccaugaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214073 - RNA, 1930 nt, Artificial Sequence
  mRNA product opt Design1 from Influenza A H1N1 hemagglutinin
gggagaaagcuuaccaugggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214074 - RNA, 1927 nt, Artificial Sequence
  mRNA product opt Design1 from Influenza A H1N1 hemagglutinin
gggagaaagcuuaccauggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214075 - RNA, 1942 nt, Artificial Sequence
  mRNA product opt Design1 from Influenza A H1N1 hemagglutinin
gggagaaagcuuaccauggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214076 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214077 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214078 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214079 - RNA, 2080 nt, Artificial Sequence
  mRNA product opt Design2 from Influenza A H1N1 hemagglutinin
ggggcgcugccuacggagguggcagccaucuccuucucggcaucaagcuuaccaugccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214080 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214081 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214082 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214083 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214084 - RNA, 2083 nt, Artificial Sequence; identical to SEQ ID NO: 213562
  mRNA product opt Design2 from Influenza A H1N1 hemagglutinin

SEQ ID NO: 214085 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214086 - RNA, 2092 nt, Artificial Sequence
  mRNA product opt Design2 from Influenza A H1N1 hemagglutinin
ggggcgcugccuacggagguggcagccaucuccuucucggcaucaagcuuaccauguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214087 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214088 - RNA, 2101 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214089 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214090 - RNA, 2098 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214091 - RNA, 2113 nt, Artificial Sequence
  mRNA product opt Design2 from Influenza A H1N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214092 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214093 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214094 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214095 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214096 - RNA, 2110 nt, Artificial Sequence
  mRNA product opt Design2 from Influenza A H1N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214097 - RNA, 2095 nt, Artificial Sequence
  mRNA product opt Design2 from Influenza A H1N1 hemagglutinin
ggggcgcugccuacggagguggcagccaucuccuucucggcaucaagcuuaccaugggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214098 - RNA, 2092 nt, Artificial Sequence
  mRNA product opt Design2 from Influenza A H1N1 hemagglutinin
ggggcgcugccuacggagguggcagccaucuccuucucggcaucaagcuuaccauggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214099 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccgacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214100 - protein, 567 aa, Artificial Sequence
  derived and/or modified sequence from Influenza A H1N1 hemagglutinin
MKWVTFISLLFLFSSAYSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214101 - protein, 567 aa, Artificial Sequence
  derived and/or modified sequence from Influenza A H1N1 hemagglutinin
MDWTWILFLVAAATRVHSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214102 - protein, 573 aa, Artificial Sequence
  derived and/or modified sequence from Influenza A H1N1 hemagglutinin
MPMGSLQPLATLYLLGMLVASCLGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214103 - protein, 573 aa, Artificial Sequence
  derived and/or modified sequence from Influenza A H1N1 hemagglutinin
MAVMAPRTLVLLLSGALALTQTWADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214104 - protein, 574 aa, Artificial Sequence
  derived and/or modified sequence from Influenza A H1N1 hemagglutinin
MAVMAPRTLVLLLSGALALTQTWAGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214105 - protein, 573 aa, Artificial Sequence
  derived and/or modified sequence from Influenza A H1N1 hemagglutinin
MASSLYSFLLALSIVYIFVAPTHSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214106 - protein, 568 aa, Artificial Sequence
  derived and/or modified sequence from Influenza A H1N1 hemagglutinin
MTRLTVLALLAGLLASSRADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214107 - protein, 565 aa, Artificial Sequence
  derived and/or modified sequence from Influenza A H1N1 hemagglutinin
MPLLLLLPLLWAGALADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214108 - protein, 568 aa, Artificial Sequence
  derived and/or modified sequence from Influenza A H1N1 hemagglutinin
MIKLKFGVFFTVLLSSAYADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214109 - protein, 567 aa, Artificial Sequence
  derived and/or modified sequence from Influenza A H1N1 hemagglutinin
MAFLWLLSCWALLGTTFGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214110 - protein, 566 aa, Artificial Sequence
  derived and/or modified sequence from Influenza A H1N1 hemagglutinin
MGVKVLFALICIAVAEADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214111 - protein, 566 aa, Artificial Sequence; identical to SEQ ID NO: 214110
  derived and/or modified sequence from Influenza A H1N1 hemagglutinin

SEQ ID NO: 214112 - protein, 566 aa, Artificial Sequence; identical to SEQ ID NO: 2667
  derived and/or modified sequence from Influenza A H1N1 hemagglutinin

SEQ ID NO: 214113 - protein, 573 aa, Artificial Sequence
  derived and/or modified sequence from Influenza A H1N1 hemagglutinin
MALWMRLLPLLALLALWGPDPAAADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214114 - protein, 569 aa, Artificial Sequence
  derived and/or modified sequence from Influenza A H1N1 hemagglutinin
MYRMQLLSCIALSLALVTNSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214115 - protein, 566 aa, Artificial Sequence
  derived and/or modified sequence from Influenza A H1N1 hemagglutinin
MRAWIFFLLCLAGRALADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214116 - protein, 572 aa, Artificial Sequence
  derived and/or modified sequence from Influenza A H1N1 hemagglutinin
MDAMKRGLCCVLLLCGAVFVSPSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214117 - protein, 570 aa, Artificial Sequence
  derived and/or modified sequence from Influenza A H1N1 hemagglutinin
MDAMKRGLCCVLLLCGAVFVSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214118 - protein, 571 aa, Artificial Sequence
  derived and/or modified sequence from Influenza A H1N1 hemagglutinin
MDAMKRGLCCVLLLCGAVFVSPDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214119 - protein, 576 aa, Artificial Sequence
  derived and/or modified sequence from Influenza A H1N1 hemagglutinin
MGVHECPAWLWLLLSLLSLPLGLPVLGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214120 - protein, 568 aa, Artificial Sequence
  derived and/or modified sequence from Influenza A H1N1 hemagglutinin
MEFGLSWVFLVALFRGVQCDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214121 - protein, 568 aa, Artificial Sequence
  derived and/or modified sequence from Influenza A H1N1 hemagglutinin
MDWTWRVFCLLAVTPGAHPDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214122 - protein, 568 aa, Artificial Sequence
  derived and/or modified sequence from Influenza A H1N1 hemagglutinin
MAWSPLFLTLITHCAGSWADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214123 - protein, 570 aa, Artificial Sequence
  derived and/or modified sequence from Influenza A H1N1 hemagglutinin
METDTLLLWVLLLWVPGSTGDDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214124 - protein, 575 aa, Artificial Sequence
  derived and/or modified sequence from Influenza A H1N1 hemagglutinin
MKTHYSSAILPILTLFVFLSINPSHGDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214125 - protein, 570 aa, Artificial Sequence
  derived and/or modified sequence from Influenza A H1N1 hemagglutinin
MGMRMMFIMFMLVVLATTVVSDTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214126 - protein, 569 aa, Artificial Sequence
  derived and/or modified sequence from Influenza A H1N1 hemagglutinin
MARPLCTLLLLMATLAGALADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214127 - protein, 574 aa, Artificial Sequence
  derived and/or modified sequence from Influenza A H1N1 hemagglutinin
MAISGVPVLGFFIIAVLMSAQESWADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214128 - RNA, 1704 nt, Artificial Sequence
  derived and/or modified sequence opt from Influenza A H1N1 hemagglutinin
augaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214129 - RNA, 1704 nt, Artificial Sequence
  derived and/or modified sequence opt from Influenza A H1N1 hemagglutinin
auggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214130 - RNA, 1722 nt, Artificial Sequence
  derived and/or modified sequence opt from Influenza A H1N1 hemagglutinin
augcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214131 - RNA, 1722 nt, Artificial Sequence
  derived and/or modified sequence opt from Influenza A H1N1 hemagglutinin
auggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214132 - RNA, 1725 nt, Artificial Sequence
  derived and/or modified sequence opt from Influenza A H1N1 hemagglutinin
auggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214133 - RNA, 1722 nt, Artificial Sequence
  derived and/or modified sequence opt from Influenza A H1N1 hemagglutinin
auggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214134 - RNA, 1707 nt, Artificial Sequence
  derived and/or modified sequence opt from Influenza A H1N1 hemagglutinin
augacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214135 - RNA, 1698 nt, Artificial Sequence
  derived and/or modified sequence opt from Influenza A H1N1 hemagglutinin
augccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214136 - RNA, 1707 nt, Artificial Sequence
  derived and/or modified sequence opt from Influenza A H1N1 hemagglutinin
augaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214137 - RNA, 1704 nt, Artificial Sequence
  derived and/or modified sequence opt from Influenza A H1N1 hemagglutinin
auggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214138 - RNA, 1701 nt, Artificial Sequence
  derived and/or modified sequence opt from Influenza A H1N1 hemagglutinin
augggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214139 - RNA, 1701 nt, Artificial Sequence
  derived and/or modified sequence opt from Influenza A H1N1 hemagglutinin
augggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214140 - RNA, 1701 nt, Artificial Sequence; identical to SEQ ID NO: 213532
  derived and/or modified sequence opt from Influenza A H1N1 hemagglutinin

SEQ ID NO: 214141 - RNA, 1722 nt, Artificial Sequence
  derived and/or modified sequence opt from Influenza A H1N1 hemagglutinin
auggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214142 - RNA, 1710 nt, Artificial Sequence
  derived and/or modified sequence opt from Influenza A H1N1 hemagglutinin
auguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214143 - RNA, 1701 nt, Artificial Sequence
  derived and/or modified sequence opt from Influenza A H1N1 hemagglutinin
augcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214144 - RNA, 1719 nt, Artificial Sequence
  derived and/or modified sequence opt from Influenza A H1N1 hemagglutinin
auggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214145 - RNA, 1713 nt, Artificial Sequence
  derived and/or modified sequence opt from Influenza A H1N1 hemagglutinin
auggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214146 - RNA, 1716 nt, Artificial Sequence
  derived and/or modified sequence opt from Influenza A H1N1 hemagglutinin
auggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214147 - RNA, 1731 nt, Artificial Sequence
  derived and/or modified sequence opt from Influenza A H1N1 hemagglutinin
augggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214148 - RNA, 1707 nt, Artificial Sequence
  derived and/or modified sequence opt from Influenza A H1N1 hemagglutinin
auggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214149 - RNA, 1707 nt, Artificial Sequence
  derived and/or modified sequence opt from Influenza A H1N1 hemagglutinin
auggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214150 - RNA, 1707 nt, Artificial Sequence
  derived and/or modified sequence opt from Influenza A H1N1 hemagglutinin
auggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214151 - RNA, 1713 nt, Artificial Sequence
  derived and/or modified sequence opt from Influenza A H1N1 hemagglutinin
auggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214152 - RNA, 1728 nt, Artificial Sequence
  derived and/or modified sequence opt from Influenza A H1N1 hemagglutinin
augaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214153 - RNA, 1713 nt, Artificial Sequence
  derived and/or modified sequence opt from Influenza A H1N1 hemagglutinin
augggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214154 - RNA, 1710 nt, Artificial Sequence
  derived and/or modified sequence opt from Influenza A H1N1 hemagglutinin
auggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214155 - RNA, 1725 nt, Artificial Sequence
  derived and/or modified sequence opt from Influenza A H1N1 hemagglutinin
auggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214156 - RNA, 1921 nt, Artificial Sequence
  mRNA product opt Design1 from Influenza A H1N1 hemagglutinin
gggagaaagcuuaccaugaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214157 - RNA, 1921 nt, Artificial Sequence
  mRNA product opt Design1 from Influenza A H1N1 hemagglutinin
gggagaaagcuuaccauggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214158 - RNA, 1939 nt, Artificial Sequence
  mRNA product opt Design1 from Influenza A H1N1 hemagglutinin
gggagaaagcuuaccaugcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214159 - RNA, 1939 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214160 - RNA, 1942 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214161 - RNA, 1939 nt, Artificial Sequence
  mRNA product opt Design1 from Influenza A H1N1 hemagglutinin
gggagaaagcuuaccauggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214162 - RNA, 1924 nt, Artificial Sequence
  mRNA product opt Design1 from Influenza A H1N1 hemagglutinin
gggagaaagcuuaccaugacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214163 - RNA, 1915 nt, Artificial Sequence
  mRNA product opt Design1 from Influenza A H1N1 hemagglutinin
gggagaaagcuuaccaugccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214164 - RNA, 1924 nt, Artificial Sequence
  mRNA product opt Design1 from Influenza A H1N1 hemagglutinin
gggagaaagcuuaccaugaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214165 - RNA, 1921 nt, Artificial Sequence
  mRNA product opt Design1 from Influenza A H1N1 hemagglutinin
gggagaaagcuuaccauggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214166 - RNA, 1918 nt, Artificial Sequence
  mRNA product opt Design1 from Influenza A H1N1 hemagglutinin
gggagaaagcuuaccaugggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214167 - RNA, 1918 nt, Artificial Sequence
  mRNA product opt Design1 from Influenza A H1N1 hemagglutinin
gggagaaagcuuaccaugggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214168 - RNA, 1918 nt, Artificial Sequence
  mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214169 - RNA, 1939 nt, Artificial Sequence
  mRNA product opt Design1 from Influenza A H1N1 hemagglutinin
gggagaaagcuuaccauggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214170 - RNA, 1927 nt, Artificial Sequence
  mRNA product opt Design1 from Influenza A H1N1 hemagglutinin
gggagaaagcuuaccauguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214171 - RNA, 1918 nt, Artificial Sequence
  mRNA product opt Design1 from Influenza A H1N1 hemagglutinin
gggagaaagcuuaccaugcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214172 - RNA, 1936 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214173 - RNA, 1930 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214174 - RNA, 1933 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214175 - RNA, 1948 nt, Artificial Sequence
  mRNA product opt Design1 from Influenza A H1N1 hemagglutinin
gggagaaagcuuaccaugggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214176 - RNA, 1924 nt, Artificial Sequence
  mRNA product opt Design1 from Influenza A H1N1 hemagglutinin
gggagaaagcuuaccauggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214177 - RNA, 1924 nt, Artificial Sequence
  mRNA product opt Design1 from Influenza A H1N1 hemagglutinin
gggagaaagcuuaccauggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214178 - RNA, 1924 nt, Artificial Sequence
  mRNA product opt Design1 from Influenza A H1N1 hemagglutinin
gggagaaagcuuaccauggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214179 - RNA, 1930 nt, Artificial Sequence
  mRNA product opt Design1 from Influenza A H1N1 hemagglutinin
gggagaaagcuuaccauggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214180 - RNA, 1945 nt, Artificial Sequence
  mRNA product opt Design1 from Influenza A H1N1 hemagglutinin
gggagaaagcuuaccaugaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214181 - RNA, 1930 nt, Artificial Sequence
  mRNA product opt Design1 from Influenza A H1N1 hemagglutinin
gggagaaagcuuaccaugggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214182 - RNA, 1927 nt, Artificial Sequence
  mRNA product opt Design1 from Influenza A H1N1 hemagglutinin
gggagaaagcuuaccauggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214183 - RNA, 1942 nt, Artificial Sequence
  mRNA product opt Design1 from Influenza A H1N1 hemagglutinin
gggagaaagcuuaccauggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214184 - RNA, 2086 nt, Artificial Sequence
  mRNA product opt Design2 from Influenza A H1N1 hemagglutinin
ggggcgcugccuacggagguggcagccaucuccuucucggcaucaagcuuaccaugaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214185 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214186 - RNA, 2104 nt, Artificial Sequence
  mRNA product opt Design2 from Influenza A H1N1 hemagglutinin
ggggcgcugccuacggagguggcagccaucuccuucucggcaucaagcuuaccaugcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214187 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214188 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214189 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214190 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214191 - RNA, 2080 nt, Artificial Sequence
  mRNA product opt Design2 from Influenza A H1N1 hemagglutinin
ggggcgcugccuacggagguggcagccaucuccuucucggcaucaagcuuaccaugccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214192 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214193 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214194 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214195 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214196 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214197 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214198 - RNA, 2092 nt, Artificial Sequence
  mRNA product opt Design2 from Influenza A H1N1 hemagglutinin
ggggcgcugccuacggagguggcagccaucuccuucucggcaucaagcuuaccauguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214199 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214200 - RNA, 2101 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214201 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214202 - RNA, 2098 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214203 - RNA, 2113 nt, Artificial Sequence
  mRNA product opt Design2 from Influenza A H1N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214204 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214205 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214206 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214207 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214208 - RNA, 2110 nt, Artificial Sequence
  mRNA product opt Design2 from Influenza A H1N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214209 - RNA, 2095 nt, Artificial Sequence
  mRNA product opt Design2 from Influenza A H1N1 hemagglutinin
ggggcgcugccuacggagguggcagccaucuccuucucggcaucaagcuuaccaugggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214210 - RNA, 2092 nt, Artificial Sequence
  mRNA product opt Design2 from Influenza A H1N1 hemagglutinin
ggggcgcugccuacggagguggcagccaucuccuucucggcaucaagcuuaccauggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214211 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214212 - protein, 567 aa, Artificial Sequence
  derived and/or modified sequence from Influenza A H1N1 hemagglutinin
MKWVTFISLLFLFSSAYSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214213 - protein, 567 aa, Artificial Sequence
  derived and/or modified sequence from Influenza A H1N1 hemagglutinin
MDWTWILFLVAAATRVHSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214214 - protein, 573 aa, Artificial Sequence
  derived and/or modified sequence from Influenza A H1N1 hemagglutinin
MPMGSLQPLATLYLLGMLVASCLGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214215 - protein, 573 aa, Artificial Sequence
  derived and/or modified sequence from Influenza A H1N1 hemagglutinin
MAVMAPRTLVLLLSGALALTQTWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214216 - protein, 574 aa, Artificial Sequence
  derived and/or modified sequence from Influenza A H1N1 hemagglutinin
MAVMAPRTLVLLLSGALALTQTWAGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214217 - protein, 573 aa, Artificial Sequence
  derived and/or modified sequence from Influenza A H1N1 hemagglutinin
MASSLYSFLLALSIVYIFVAPTHSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214218 - protein, 568 aa, Artificial Sequence
  derived and/or modified sequence from Influenza A H1N1 hemagglutinin
MTRLTVLALLAGLLASSRADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214219 - protein, 565 aa, Artificial Sequence
  derived and/or modified sequence from Influenza A H1N1 hemagglutinin
MPLLLLLPLLWAGALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214220 - protein, 568 aa, Artificial Sequence
  derived and/or modified sequence from Influenza A H1N1 hemagglutinin
MIKLKFGVFFTVLLSSAYADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214221 - protein, 567 aa, Artificial Sequence
  derived and/or modified sequence from Influenza A H1N1 hemagglutinin
MAFLWLLSCWALLGTTFGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214222 - protein, 566 aa, Artificial Sequence
  derived and/or modified sequence from Influenza A H1N1 hemagglutinin
MGVKVLFALICIAVAEADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214223 - protein, 566 aa, Artificial Sequence; identical to SEQ ID NO: 214222
  derived and/or modified sequence from Influenza A H1N1 hemagglutinin

SEQ ID NO: 214224 - protein, 566 aa, Artificial Sequence
  derived and/or modified sequence from Influenza A H1N1 hemagglutinin
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214225 - protein, 573 aa, Artificial Sequence
  derived and/or modified sequence from Influenza A H1N1 hemagglutinin
MALWMRLLPLLALLALWGPDPAAADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214226 - protein, 569 aa, Artificial Sequence
  derived and/or modified sequence from Influenza A H1N1 hemagglutinin
MYRMQLLSCIALSLALVTNSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214227 - protein, 566 aa, Artificial Sequence
  derived and/or modified sequence from Influenza A H1N1 hemagglutinin
MRAWIFFLLCLAGRALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214228 - protein, 572 aa, Artificial Sequence
  derived and/or modified sequence from Influenza A H1N1 hemagglutinin
MDAMKRGLCCVLLLCGAVFVSPSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214229 - protein, 570 aa, Artificial Sequence
  derived and/or modified sequence from Influenza A H1N1 hemagglutinin
MDAMKRGLCCVLLLCGAVFVSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214230 - protein, 571 aa, Artificial Sequence
  derived and/or modified sequence from Influenza A H1N1 hemagglutinin
MDAMKRGLCCVLLLCGAVFVSPDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214231 - protein, 576 aa, Artificial Sequence
  derived and/or modified sequence from Influenza A H1N1 hemagglutinin
MGVHECPAWLWLLLSLLSLPLGLPVLGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214232 - protein, 568 aa, Artificial Sequence
  derived and/or modified sequence from Influenza A H1N1 hemagglutinin
MEFGLSWVFLVALFRGVQCDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214233 - protein, 568 aa, Artificial Sequence
  derived and/or modified sequence from Influenza A H1N1 hemagglutinin
MDWTWRVFCLLAVTPGAHPDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214234 - protein, 568 aa, Artificial Sequence
  derived and/or modified sequence from Influenza A H1N1 hemagglutinin
MAWSPLFLTLITHCAGSWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214235 - protein, 570 aa, Artificial Sequence
  derived and/or modified sequence from Influenza A H1N1 hemagglutinin
METDTLLLWVLLLWVPGSTGDDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214236 - protein, 575 aa, Artificial Sequence
  derived and/or modified sequence from Influenza A H1N1 hemagglutinin
MKTHYSSAILPILTLFVFLSINPSHGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214237 - protein, 570 aa, Artificial Sequence
  derived and/or modified sequence from Influenza A H1N1 hemagglutinin
MGMRMMFIMFMLVVLATTVVSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214238 - protein, 569 aa, Artificial Sequence
  derived and/or modified sequence from Influenza A H1N1 hemagglutinin
MARPLCTLLLLMATLAGALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214239 - protein, 574 aa, Artificial Sequence
  derived and/or modified sequence from Influenza A H1N1 hemagglutinin
MAISGVPVLGFFIIAVLMSAQESWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214240 - RNA, 1704 nt, Artificial Sequence
  derived and/or modified sequence opt from Influenza A H1N1 hemagglutinin
augaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214241 - RNA, 1704 nt, Artificial Sequence
  derived and/or modified sequence opt from Influenza A H1N1 hemagglutinin
auggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214242 - RNA, 1722 nt, Artificial Sequence
  derived and/or modified sequence opt from Influenza A H1N1 hemagglutinin
augcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214243 - RNA, 1722 nt, Artificial Sequence
  derived and/or modified sequence opt from Influenza A H1N1 hemagglutinin
auggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214244 - RNA, 1725 nt, Artificial Sequence
  derived and/or modified sequence opt from Influenza A H1N1 hemagglutinin
auggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214245 - RNA, 1722 nt, Artificial Sequence
  derived and/or modified sequence opt from Influenza A H1N1 hemagglutinin
auggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214246 - RNA, 1707 nt, Artificial Sequence
  derived and/or modified sequence opt from Influenza A H1N1 hemagglutinin
augacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214247 - RNA, 1698 nt, Artificial Sequence
  derived and/or modified sequence opt from Influenza A H1N1 hemagglutinin
augccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214248 - RNA, 1707 nt, Artificial Sequence
  derived and/or modified sequence opt from Influenza A H1N1 hemagglutinin
augaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214249 - RNA, 1704 nt, Artificial Sequence
  derived and/or modified sequence opt from Influenza A H1N1 hemagglutinin
auggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214250 - RNA, 1701 nt, Artificial Sequence
  derived and/or modified sequence opt from Influenza A H1N1 hemagglutinin
augggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214251 - RNA, 1701 nt, Artificial Sequence
  derived and/or modified sequence opt from Influenza A H1N1 hemagglutinin
augggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214252 - RNA, 1701 nt, Artificial Sequence
  derived and/or modified sequence opt from Influenza A H1N1 hemagglutinin
augaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214253 - RNA, 1722 nt, Artificial Sequence
  derived and/or modified sequence opt from Influenza A H1N1 hemagglutinin
auggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214254 - RNA, 1710 nt, Artificial Sequence
  derived and/or modified sequence opt from Influenza A H1N1 hemagglutinin
auguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214255 - RNA, 1701 nt, Artificial Sequence
  derived and/or modified sequence opt from Influenza A H1N1 hemagglutinin
augcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214256 - RNA, 1719 nt, Artificial Sequence
  derived and/or modified sequence opt from Influenza A H1N1 hemagglutinin
auggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214257 - RNA, 1713 nt, Artificial Sequence
  derived and/or modified sequence opt from Influenza A H1N1 hemagglutinin
auggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214258 - RNA, 1716 nt, Artificial Sequence
  derived and/or modified sequence opt from Influenza A H1N1 hemagglutinin
auggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214259 - RNA, 1731 nt, Artificial Sequence
  derived and/or modified sequence opt from Influenza A H1N1 hemagglutinin
augggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214260 - RNA, 1707 nt, Artificial Sequence
  derived and/or modified sequence opt from Influenza A H1N1 hemagglutinin
auggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214261 - RNA, 1707 nt, Artificial Sequence
  derived and/or modified sequence opt from Influenza A H1N1 hemagglutinin
auggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214262 - RNA, 1707 nt, Artificial Sequence
  derived and/or modified sequence opt from Influenza A H1N1 hemagglutinin
auggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214263 - RNA, 1713 nt, Artificial Sequence
  derived and/or modified sequence opt from Influenza A H1N1 hemagglutinin
auggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214264 - RNA, 1728 nt, Artificial Sequence
  derived and/or modified sequence opt from Influenza A H1N1 hemagglutinin
augaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214265 - RNA, 1713 nt, Artificial Sequence
  derived and/or modified sequence opt from Influenza A H1N1 hemagglutinin
augggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214266 - RNA, 1710 nt, Artificial Sequence
  derived and/or modified sequence opt from Influenza A H1N1 hemagglutinin
auggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214267 - RNA, 1725 nt, Artificial Sequence
  derived and/or modified sequence opt from Influenza A H1N1 hemagglutinin
auggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 214268 - RNA, 1942 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214269 - RNA, 1939 nt, Artificial Sequence
  mRNA product opt Design1 from Influenza A H1N1 hemagglutinin
gggagaaagcuuaccauggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214270 - RNA, 1924 nt, Artificial Sequence
  mRNA product opt Design1 from Influenza A H1N1 hemagglutinin
gggagaaagcuuaccaugacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214271 - RNA, 1915 nt, Artificial Sequence
  mRNA product opt Design1 from Influenza A H1N1 hemagglutinin
gggagaaagcuuaccaugccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214272 - RNA, 1924 nt, Artificial Sequence
  mRNA product opt Design1 from Influenza A H1N1 hemagglutinin
gggagaaagcuuaccaugaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214273 - RNA, 1921 nt, Artificial Sequence
  mRNA product opt Design1 from Influenza A H1N1 hemagglutinin
gggagaaagcuuaccauggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214274 - RNA, 1918 nt, Artificial Sequence
  mRNA product opt Design1 from Influenza A H1N1 hemagglutinin
gggagaaagcuuaccaugggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214275 - RNA, 1918 nt, Artificial Sequence
  mRNA product opt Design1 from Influenza A H1N1 hemagglutinin
gggagaaagcuuaccaugggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214276 - RNA, 1918 nt, Artificial Sequence
  mRNA product opt Design1 from Influenza A H1N1 hemagglutinin
gggagaaagcuuaccaugaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214277 - RNA, 1939 nt, Artificial Sequence
  mRNA product opt Design1 from Influenza A H1N1 hemagglutinin
gggagaaagcuuaccauggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214278 - RNA, 1927 nt, Artificial Sequence
  mRNA product opt Design1 from Influenza A H1N1 hemagglutinin
gggagaaagcuuaccauguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214279 - RNA, 1918 nt, Artificial Sequence
  mRNA product opt Design1 from Influenza A H1N1 hemagglutinin
gggagaaagcuuaccaugcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214280 - RNA, 1936 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214281 - RNA, 1930 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214282 - RNA, 1933 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214283 - RNA, 1948 nt, Artificial Sequence
  mRNA product opt Design1 from Influenza A H1N1 hemagglutinin
gggagaaagcuuaccaugggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214284 - RNA, 1924 nt, Artificial Sequence
  mRNA product opt Design1 from Influenza A H1N1 hemagglutinin
gggagaaagcuuaccauggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214285 - RNA, 1924 nt, Artificial Sequence
  mRNA product opt Design1 from Influenza A H1N1 hemagglutinin
gggagaaagcuuaccauggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214286 - RNA, 1924 nt, Artificial Sequence
  mRNA product opt Design1 from Influenza A H1N1 hemagglutinin
gggagaaagcuuaccauggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214287 - RNA, 1930 nt, Artificial Sequence
  mRNA product opt Design1 from Influenza A H1N1 hemagglutinin
gggagaaagcuuaccauggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214288 - RNA, 1945 nt, Artificial Sequence
  mRNA product opt Design1 from Influenza A H1N1 hemagglutinin
gggagaaagcuuaccaugaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214289 - RNA, 1930 nt, Artificial Sequence
  mRNA product opt Design1 from Influenza A H1N1 hemagglutinin
gggagaaagcuuaccaugggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214290 - RNA, 1927 nt, Artificial Sequence
  mRNA product opt Design1 from Influenza A H1N1 hemagglutinin
gggagaaagcuuaccauggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214291 - RNA, 1942 nt, Artificial Sequence
  mRNA product opt Design1 from Influenza A H1N1 hemagglutinin
gggagaaagcuuaccauggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214292 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214293 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214294 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214295 - RNA, 2080 nt, Artificial Sequence
  mRNA product opt Design2 from Influenza A H1N1 hemagglutinin
ggggcgcugccuacggagguggcagccaucuccuucucggcaucaagcuuaccaugccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214296 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214297 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214298 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214299 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214300 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214301 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214302 - RNA, 2092 nt, Artificial Sequence
  mRNA product opt Design2 from Influenza A H1N1 hemagglutinin
ggggcgcugccuacggagguggcagccaucuccuucucggcaucaagcuuaccauguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214303 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214304 - RNA, 2101 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214305 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214306 - RNA, 2098 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214307 - RNA, 2113 nt, Artificial Sequence
  mRNA product opt Design2 from Influenza A H1N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214308 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214309 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214310 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214311 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214312 - RNA, 2110 nt, Artificial Sequence
  mRNA product opt Design2 from Influenza A H1N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214313 - RNA, 2095 nt, Artificial Sequence
  mRNA product opt Design2 from Influenza A H1N1 hemagglutinin
ggggcgcugccuacggagguggcagccaucuccuucucggcaucaagcuuaccaugggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214314 - RNA, 2092 nt, Artificial Sequence
  mRNA product opt Design2 from Influenza A H1N1 hemagglutinin
ggggcgcugccuacggagguggcagccaucuccuucucggcaucaagcuuaccauggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214315 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214316 - protein, 567 aa, Artificial Sequence
  derived and/or modified sequence from Influenza A H1N1 hemagglutinin
MKWVTFISLLFLFSSAYSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214317 - protein, 567 aa, Artificial Sequence
  derived and/or modified sequence from Influenza A H1N1 hemagglutinin
MDWTWILFLVAAATRVHSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214318 - protein, 573 aa, Artificial Sequence
  derived and/or modified sequence from Influenza A H1N1 hemagglutinin
MPMGSLQPLATLYLLGMLVASCLGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214319 - protein, 573 aa, Artificial Sequence
  derived and/or modified sequence from Influenza A H1N1 hemagglutinin
MAVMAPRTLVLLLSGALALTQTWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214320 - protein, 574 aa, Artificial Sequence
  derived and/or modified sequence from Influenza A H1N1 hemagglutinin
MAVMAPRTLVLLLSGALALTQTWAGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214321 - protein, 573 aa, Artificial Sequence
  derived and/or modified sequence from Influenza A H1N1 hemagglutinin
MASSLYSFLLALSIVYIFVAPTHSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214322 - protein, 568 aa, Artificial Sequence
  derived and/or modified sequence from Influenza A H1N1 hemagglutinin
MTRLTVLALLAGLLASSRADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214323 - protein, 565 aa, Artificial Sequence
  derived and/or modified sequence from Influenza A H1N1 hemagglutinin
MPLLLLLPLLWAGALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214324 - protein, 568 aa, Artificial Sequence
  derived and/or modified sequence from Influenza A H1N1 hemagglutinin
MIKLKFGVFFTVLLSSAYADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214325 - protein, 567 aa, Artificial Sequence
  derived and/or modified sequence from Influenza A H1N1 hemagglutinin
MAFLWLLSCWALLGTTFGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214326 - protein, 566 aa, Artificial Sequence
  derived and/or modified sequence from Influenza A H1N1 hemagglutinin
MGVKVLFALICIAVAEADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214327 - protein, 566 aa, Artificial Sequence; identical to SEQ ID NO: 214326
  derived and/or modified sequence from Influenza A H1N1 hemagglutinin

SEQ ID NO: 214328 - protein, 566 aa, Artificial Sequence
  derived and/or modified sequence from Influenza A H1N1 hemagglutinin
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214329 - protein, 573 aa, Artificial Sequence
  derived and/or modified sequence from Influenza A H1N1 hemagglutinin
MALWMRLLPLLALLALWGPDPAAADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214330 - protein, 569 aa, Artificial Sequence
  derived and/or modified sequence from Influenza A H1N1 hemagglutinin
MYRMQLLSCIALSLALVTNSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214331 - protein, 566 aa, Artificial Sequence
  derived and/or modified sequence from Influenza A H1N1 hemagglutinin
MRAWIFFLLCLAGRALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214332 - protein, 572 aa, Artificial Sequence
  derived and/or modified sequence from Influenza A H1N1 hemagglutinin
MDAMKRGLCCVLLLCGAVFVSPSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214333 - protein, 570 aa, Artificial Sequence
  derived and/or modified sequence from Influenza A H1N1 hemagglutinin
MDAMKRGLCCVLLLCGAVFVSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214334 - protein, 571 aa, Artificial Sequence
  derived and/or modified sequence from Influenza A H1N1 hemagglutinin
MDAMKRGLCCVLLLCGAVFVSPDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214335 - protein, 576 aa, Artificial Sequence
  derived and/or modified sequence from Influenza A H1N1 hemagglutinin
MGVHECPAWLWLLLSLLSLPLGLPVLGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214336 - protein, 568 aa, Artificial Sequence
  derived and/or modified sequence from Influenza A H1N1 hemagglutinin
MEFGLSWVFLVALFRGVQCDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214337 - protein, 568 aa, Artificial Sequence
  derived and/or modified sequence from Influenza A H1N1 hemagglutinin
MDWTWRVFCLLAVTPGAHPDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214338 - protein, 568 aa, Artificial Sequence
  derived and/or modified sequence from Influenza A H1N1 hemagglutinin
MAWSPLFLTLITHCAGSWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214339 - protein, 570 aa, Artificial Sequence
  derived and/or modified sequence from Influenza A H1N1 hemagglutinin
METDTLLLWVLLLWVPGSTGDDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214340 - protein, 575 aa, Artificial Sequence
  derived and/or modified sequence from Influenza A H1N1 hemagglutinin
MKTHYSSAILPILTLFVFLSINPSHGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214341 - protein, 570 aa, Artificial Sequence
  derived and/or modified sequence from Influenza A H1N1 hemagglutinin
MGMRMMFIMFMLVVLATTVVSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214342 - protein, 569 aa, Artificial Sequence
  derived and/or modified sequence from Influenza A H1N1 hemagglutinin
MARPLCTLLLLMATLAGALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214343 - protein, 574 aa, Artificial Sequence
  derived and/or modified sequence from Influenza A H1N1 hemagglutinin
MAISGVPVLGFFIIAVLMSAQESWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214344 - RNA, 1704 nt, Artificial Sequence
  derived and/or modified sequence opt from Influenza A H1N1 hemagglutinin
augaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214345 - RNA, 1704 nt, Artificial Sequence
  derived and/or modified sequence opt from Influenza A H1N1 hemagglutinin
auggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214346 - RNA, 1722 nt, Artificial Sequence
  derived and/or modified sequence opt from Influenza A H1N1 hemagglutinin
augcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214347 - RNA, 1722 nt, Artificial Sequence
  derived and/or modified sequence opt from Influenza A H1N1 hemagglutinin
auggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214348 - RNA, 1725 nt, Artificial Sequence
  derived and/or modified sequence opt from Influenza A H1N1 hemagglutinin
auggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214349 - RNA, 1722 nt, Artificial Sequence
  derived and/or modified sequence opt from Influenza A H1N1 hemagglutinin
auggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214350 - RNA, 1707 nt, Artificial Sequence
  derived and/or modified sequence opt from Influenza A H1N1 hemagglutinin
augacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214351 - RNA, 1698 nt, Artificial Sequence
  derived and/or modified sequence opt from Influenza A H1N1 hemagglutinin
augccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214352 - RNA, 1707 nt, Artificial Sequence
  derived and/or modified sequence opt from Influenza A H1N1 hemagglutinin
augaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214353 - RNA, 1704 nt, Artificial Sequence
  derived and/or modified sequence opt from Influenza A H1N1 hemagglutinin
auggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214354 - RNA, 1701 nt, Artificial Sequence
  derived and/or modified sequence opt from Influenza A H1N1 hemagglutinin
augggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214355 - RNA, 1701 nt, Artificial Sequence
  derived and/or modified sequence opt from Influenza A H1N1 hemagglutinin
augggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214356 - RNA, 1701 nt, Artificial Sequence
  derived and/or modified sequence opt from Influenza A H1N1 hemagglutinin
augaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214357 - RNA, 1722 nt, Artificial Sequence
  derived and/or modified sequence opt from Influenza A H1N1 hemagglutinin
auggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214358 - RNA, 1710 nt, Artificial Sequence
  derived and/or modified sequence opt from Influenza A H1N1 hemagglutinin
auguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214359 - RNA, 1701 nt, Artificial Sequence
  derived and/or modified sequence opt from Influenza A H1N1 hemagglutinin
augcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214360 - RNA, 1719 nt, Artificial Sequence
  derived and/or modified sequence opt from Influenza A H1N1 hemagglutinin
auggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214361 - RNA, 1713 nt, Artificial Sequence
  derived and/or modified sequence opt from Influenza A H1N1 hemagglutinin
auggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214362 - RNA, 1716 nt, Artificial Sequence
  derived and/or modified sequence opt from Influenza A H1N1 hemagglutinin
auggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214363 - RNA, 1731 nt, Artificial Sequence
  derived and/or modified sequence opt from Influenza A H1N1 hemagglutinin
augggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214364 - RNA, 1707 nt, Artificial Sequence
  derived and/or modified sequence opt from Influenza A H1N1 hemagglutinin
auggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214365 - RNA, 1707 nt, Artificial Sequence
  derived and/or modified sequence opt from Influenza A H1N1 hemagglutinin
auggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214366 - RNA, 1707 nt, Artificial Sequence
  derived and/or modified sequence opt from Influenza A H1N1 hemagglutinin
auggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214367 - RNA, 1713 nt, Artificial Sequence
  derived and/or modified sequence opt from Influenza A H1N1 hemagglutinin
auggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214368 - RNA, 1728 nt, Artificial Sequence
  derived and/or modified sequence opt from Influenza A H1N1 hemagglutinin
augaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214369 - RNA, 1713 nt, Artificial Sequence
  derived and/or modified sequence opt from Influenza A H1N1 hemagglutinin
augggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214370 - RNA, 1710 nt, Artificial Sequence
  derived and/or modified sequence opt from Influenza A H1N1 hemagglutinin
auggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214371 - RNA, 1725 nt, Artificial Sequence
  derived and/or modified sequence opt from Influenza A H1N1 hemagglutinin
auggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214372 - RNA, 1942 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214373 - RNA, 1939 nt, Artificial Sequence
  mRNA product opt Design1 from Influenza A H1N1 hemagglutinin
gggagaaagcuuaccauggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214374 - RNA, 1924 nt, Artificial Sequence
  mRNA product opt Design1 from Influenza A H1N1 hemagglutinin
gggagaaagcuuaccaugacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214375 - RNA, 1915 nt, Artificial Sequence
  mRNA product opt Design1 from Influenza A H1N1 hemagglutinin
gggagaaagcuuaccaugccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214376 - RNA, 1924 nt, Artificial Sequence
  mRNA product opt Design1 from Influenza A H1N1 hemagglutinin
gggagaaagcuuaccaugaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214377 - RNA, 1921 nt, Artificial Sequence
  mRNA product opt Design1 from Influenza A H1N1 hemagglutinin
gggagaaagcuuaccauggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214378 - RNA, 1918 nt, Artificial Sequence
  mRNA product opt Design1 from Influenza A H1N1 hemagglutinin
gggagaaagcuuaccaugggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214379 - RNA, 1918 nt, Artificial Sequence
  mRNA product opt Design1 from Influenza A H1N1 hemagglutinin
gggagaaagcuuaccaugggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214380 - RNA, 1918 nt, Artificial Sequence
  mRNA product opt Design1 from Influenza A H1N1 hemagglutinin
gggagaaagcuuaccaugaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214381 - RNA, 1939 nt, Artificial Sequence
  mRNA product opt Design1 from Influenza A H1N1 hemagglutinin
gggagaaagcuuaccauggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214382 - RNA, 1927 nt, Artificial Sequence
  mRNA product opt Design1 from Influenza A H1N1 hemagglutinin
gggagaaagcuuaccauguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214383 - RNA, 1918 nt, Artificial Sequence
  mRNA product opt Design1 from Influenza A H1N1 hemagglutinin
gggagaaagcuuaccaugcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214384 - RNA, 1936 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214385 - RNA, 1930 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214386 - RNA, 1933 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214387 - RNA, 1948 nt, Artificial Sequence
  mRNA product opt Design1 from Influenza A H1N1 hemagglutinin
gggagaaagcuuaccaugggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214388 - RNA, 1924 nt, Artificial Sequence
  mRNA product opt Design1 from Influenza A H1N1 hemagglutinin
gggagaaagcuuaccauggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214389 - RNA, 1924 nt, Artificial Sequence
  mRNA product opt Design1 from Influenza A H1N1 hemagglutinin
gggagaaagcuuaccauggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214390 - RNA, 1924 nt, Artificial Sequence
  mRNA product opt Design1 from Influenza A H1N1 hemagglutinin
gggagaaagcuuaccauggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214391 - RNA, 1930 nt, Artificial Sequence
  mRNA product opt Design1 from Influenza A H1N1 hemagglutinin
gggagaaagcuuaccauggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214392 - RNA, 1945 nt, Artificial Sequence
  mRNA product opt Design1 from Influenza A H1N1 hemagglutinin
gggagaaagcuuaccaugaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214393 - RNA, 1930 nt, Artificial Sequence
  mRNA product opt Design1 from Influenza A H1N1 hemagglutinin
gggagaaagcuuaccaugggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214394 - RNA, 1927 nt, Artificial Sequence
  mRNA product opt Design1 from Influenza A H1N1 hemagglutinin
gggagaaagcuuaccauggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214395 - RNA, 1942 nt, Artificial Sequence
  mRNA product opt Design1 from Influenza A H1N1 hemagglutinin
gggagaaagcuuaccauggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214396 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214397 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214398 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214399 - RNA, 2080 nt, Artificial Sequence
  mRNA product opt Design2 from Influenza A H1N1 hemagglutinin
ggggcgcugccuacggagguggcagccaucuccuucucggcaucaagcuuaccaugccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214400 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214401 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214402 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214403 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214404 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214405 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214406 - RNA, 2092 nt, Artificial Sequence
  mRNA product opt Design2 from Influenza A H1N1 hemagglutinin
ggggcgcugccuacggagguggcagccaucuccuucucggcaucaagcuuaccauguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214407 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214408 - RNA, 2101 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214409 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214410 - RNA, 2098 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214411 - RNA, 2113 nt, Artificial Sequence
  mRNA product opt Design2 from Influenza A H1N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214412 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214413 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214414 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214415 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214416 - RNA, 2110 nt, Artificial Sequence
  mRNA product opt Design2 from Influenza A H1N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214417 - RNA, 2095 nt, Artificial Sequence
  mRNA product opt Design2 from Influenza A H1N1 hemagglutinin
ggggcgcugccuacggagguggcagccaucuccuucucggcaucaagcuuaccaugggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214418 - RNA, 2092 nt, Artificial Sequence
  mRNA product opt Design2 from Influenza A H1N1 hemagglutinin
ggggcgcugccuacggagguggcagccaucuccuucucggcaucaagcuuaccauggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214419 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214420 - protein, 567 aa, Artificial Sequence
  derived and/or modified sequence from Influenza A H1N1 hemagglutinin
MKWVTFISLLFLFSSAYSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214421 - protein, 567 aa, Artificial Sequence
  derived and/or modified sequence from Influenza A H1N1 hemagglutinin
MDWTWILFLVAAATRVHSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214422 - protein, 573 aa, Artificial Sequence
  derived and/or modified sequence from Influenza A H1N1 hemagglutinin
MPMGSLQPLATLYLLGMLVASCLGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214423 - protein, 573 aa, Artificial Sequence
  derived and/or modified sequence from Influenza A H1N1 hemagglutinin
MAVMAPRTLVLLLSGALALTQTWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214424 - protein, 574 aa, Artificial Sequence
  derived and/or modified sequence from Influenza A H1N1 hemagglutinin
MAVMAPRTLVLLLSGALALTQTWAGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214425 - protein, 573 aa, Artificial Sequence
  derived and/or modified sequence from Influenza A H1N1 hemagglutinin
MASSLYSFLLALSIVYIFVAPTHSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214426 - protein, 568 aa, Artificial Sequence
  derived and/or modified sequence from Influenza A H1N1 hemagglutinin
MTRLTVLALLAGLLASSRADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214427 - protein, 565 aa, Artificial Sequence
  derived and/or modified sequence from Influenza A H1N1 hemagglutinin
MPLLLLLPLLWAGALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214428 - protein, 568 aa, Artificial Sequence
  derived and/or modified sequence from Influenza A H1N1 hemagglutinin
MIKLKFGVFFTVLLSSAYADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214429 - protein, 567 aa, Artificial Sequence
  derived and/or modified sequence from Influenza A H1N1 hemagglutinin
MAFLWLLSCWALLGTTFGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214430 - protein, 566 aa, Artificial Sequence
  derived and/or modified sequence from Influenza A H1N1 hemagglutinin
MGVKVLFALICIAVAEADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214431 - protein, 566 aa, Artificial Sequence; identical to SEQ ID NO: 214430
  derived and/or modified sequence from Influenza A H1N1 hemagglutinin

SEQ ID NO: 214432 - protein, 566 aa, Artificial Sequence
  derived and/or modified sequence from Influenza A H1N1 hemagglutinin
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214433 - protein, 573 aa, Artificial Sequence
  derived and/or modified sequence from Influenza A H1N1 hemagglutinin
MALWMRLLPLLALLALWGPDPAAADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214434 - protein, 569 aa, Artificial Sequence
  derived and/or modified sequence from Influenza A H1N1 hemagglutinin
MYRMQLLSCIALSLALVTNSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214435 - protein, 566 aa, Artificial Sequence
  derived and/or modified sequence from Influenza A H1N1 hemagglutinin
MRAWIFFLLCLAGRALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214436 - protein, 572 aa, Artificial Sequence
  derived and/or modified sequence from Influenza A H1N1 hemagglutinin
MDAMKRGLCCVLLLCGAVFVSPSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214437 - protein, 570 aa, Artificial Sequence
  derived and/or modified sequence from Influenza A H1N1 hemagglutinin
MDAMKRGLCCVLLLCGAVFVSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214438 - protein, 571 aa, Artificial Sequence
  derived and/or modified sequence from Influenza A H1N1 hemagglutinin
MDAMKRGLCCVLLLCGAVFVSPDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214439 - protein, 576 aa, Artificial Sequence
  derived and/or modified sequence from Influenza A H1N1 hemagglutinin
MGVHECPAWLWLLLSLLSLPLGLPVLGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214440 - protein, 568 aa, Artificial Sequence
  derived and/or modified sequence from Influenza A H1N1 hemagglutinin
MEFGLSWVFLVALFRGVQCDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214441 - protein, 568 aa, Artificial Sequence
  derived and/or modified sequence from Influenza A H1N1 hemagglutinin
MDWTWRVFCLLAVTPGAHPDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214442 - protein, 568 aa, Artificial Sequence
  derived and/or modified sequence from Influenza A H1N1 hemagglutinin
MAWSPLFLTLITHCAGSWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214443 - protein, 570 aa, Artificial Sequence
  derived and/or modified sequence from Influenza A H1N1 hemagglutinin
METDTLLLWVLLLWVPGSTGDDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214444 - protein, 575 aa, Artificial Sequence
  derived and/or modified sequence from Influenza A H1N1 hemagglutinin
MKTHYSSAILPILTLFVFLSINPSHGDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214445 - protein, 570 aa, Artificial Sequence
  derived and/or modified sequence from Influenza A H1N1 hemagglutinin
MGMRMMFIMFMLVVLATTVVSDTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214446 - protein, 569 aa, Artificial Sequence
  derived and/or modified sequence from Influenza A H1N1 hemagglutinin
MARPLCTLLLLMATLAGALADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214447 - protein, 574 aa, Artificial Sequence
  derived and/or modified sequence from Influenza A H1N1 hemagglutinin
MAISGVPVLGFFIIAVLMSAQESWADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 214448 - RNA, 1704 nt, Artificial Sequence
  derived and/or modified sequence opt from Influenza A H1N1 hemagglutinin
augaagugggugaccuucaucagccugcucuuccuguucuccagcgccuacuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214449 - RNA, 1704 nt, Artificial Sequence
  derived and/or modified sequence opt from Influenza A H1N1 hemagglutinin
auggacuggaccuggauccuguuccucguggccgccgcgacccgcguccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214450 - RNA, 1722 nt, Artificial Sequence
  derived and/or modified sequence opt from Influenza A H1N1 hemagglutinin
augcccaugggcagccugcagccgcucgccacccuguaccugcucgggaugcugguggccuccugccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214451 - RNA, 1722 nt, Artificial Sequence
  derived and/or modified sequence opt from Influenza A H1N1 hemagglutinin
auggccgugauggccccgcggacccugguccuccugcugagcggcgcgcucgcccugacccagacgugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214452 - RNA, 1725 nt, Artificial Sequence
  derived and/or modified sequence opt from Influenza A H1N1 hemagglutinin
auggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214453 - RNA, 1722 nt, Artificial Sequence
  derived and/or modified sequence opt from Influenza A H1N1 hemagglutinin
auggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214454 - RNA, 1707 nt, Artificial Sequence
  derived and/or modified sequence opt from Influenza A H1N1 hemagglutinin
augacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214455 - RNA, 1698 nt, Artificial Sequence
  derived and/or modified sequence opt from Influenza A H1N1 hemagglutinin
augccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214456 - RNA, 1707 nt, Artificial Sequence
  derived and/or modified sequence opt from Influenza A H1N1 hemagglutinin
augaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214457 - RNA, 1704 nt, Artificial Sequence
  derived and/or modified sequence opt from Influenza A H1N1 hemagglutinin
auggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214458 - RNA, 1701 nt, Artificial Sequence
  derived and/or modified sequence opt from Influenza A H1N1 hemagglutinin
augggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214459 - RNA, 1701 nt, Artificial Sequence
  derived and/or modified sequence opt from Influenza A H1N1 hemagglutinin
augggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214460 - RNA, 1701 nt, Artificial Sequence
  derived and/or modified sequence opt from Influenza A H1N1 hemagglutinin
augaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214461 - RNA, 1722 nt, Artificial Sequence
  derived and/or modified sequence opt from Influenza A H1N1 hemagglutinin
auggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214462 - RNA, 1710 nt, Artificial Sequence
  derived and/or modified sequence opt from Influenza A H1N1 hemagglutinin
auguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214463 - RNA, 1701 nt, Artificial Sequence
  derived and/or modified sequence opt from Influenza A H1N1 hemagglutinin
augcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214464 - RNA, 1719 nt, Artificial Sequence
  derived and/or modified sequence opt from Influenza A H1N1 hemagglutinin
auggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214465 - RNA, 1713 nt, Artificial Sequence
  derived and/or modified sequence opt from Influenza A H1N1 hemagglutinin
auggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214466 - RNA, 1716 nt, Artificial Sequence
  derived and/or modified sequence opt from Influenza A H1N1 hemagglutinin
auggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214467 - RNA, 1731 nt, Artificial Sequence
  derived and/or modified sequence opt from Influenza A H1N1 hemagglutinin
augggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214468 - RNA, 1707 nt, Artificial Sequence
  derived and/or modified sequence opt from Influenza A H1N1 hemagglutinin
auggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214469 - RNA, 1707 nt, Artificial Sequence
  derived and/or modified sequence opt from Influenza A H1N1 hemagglutinin
auggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214470 - RNA, 1707 nt, Artificial Sequence
  derived and/or modified sequence opt from Influenza A H1N1 hemagglutinin
auggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214471 - RNA, 1713 nt, Artificial Sequence
  derived and/or modified sequence opt from Influenza A H1N1 hemagglutinin
auggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214472 - RNA, 1728 nt, Artificial Sequence
  derived and/or modified sequence opt from Influenza A H1N1 hemagglutinin
augaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214473 - RNA, 1713 nt, Artificial Sequence
  derived and/or modified sequence opt from Influenza A H1N1 hemagglutinin
augggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214474 - RNA, 1710 nt, Artificial Sequence
  derived and/or modified sequence opt from Influenza A H1N1 hemagglutinin
auggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214475 - RNA, 1725 nt, Artificial Sequence
  derived and/or modified sequence opt from Influenza A H1N1 hemagglutinin
auggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 214476 - RNA, 1942 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214477 - RNA, 1939 nt, Artificial Sequence
  mRNA product opt Design1 from Influenza A H1N1 hemagglutinin
gggagaaagcuuaccauggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214478 - RNA, 1924 nt, Artificial Sequence
  mRNA product opt Design1 from Influenza A H1N1 hemagglutinin
gggagaaagcuuaccaugacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214479 - RNA, 1915 nt, Artificial Sequence
  mRNA product opt Design1 from Influenza A H1N1 hemagglutinin
gggagaaagcuuaccaugccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214480 - RNA, 1924 nt, Artificial Sequence
  mRNA product opt Design1 from Influenza A H1N1 hemagglutinin
gggagaaagcuuaccaugaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214481 - RNA, 1921 nt, Artificial Sequence
  mRNA product opt Design1 from Influenza A H1N1 hemagglutinin
gggagaaagcuuaccauggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214482 - RNA, 1918 nt, Artificial Sequence
  mRNA product opt Design1 from Influenza A H1N1 hemagglutinin
gggagaaagcuuaccaugggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214483 - RNA, 1918 nt, Artificial Sequence
  mRNA product opt Design1 from Influenza A H1N1 hemagglutinin
gggagaaagcuuaccaugggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214484 - RNA, 1918 nt, Artificial Sequence
  mRNA product opt Design1 from Influenza A H1N1 hemagglutinin
gggagaaagcuuaccaugaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214485 - RNA, 1939 nt, Artificial Sequence
  mRNA product opt Design1 from Influenza A H1N1 hemagglutinin
gggagaaagcuuaccauggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214486 - RNA, 1927 nt, Artificial Sequence
  mRNA product opt Design1 from Influenza A H1N1 hemagglutinin
gggagaaagcuuaccauguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214487 - RNA, 1918 nt, Artificial Sequence
  mRNA product opt Design1 from Influenza A H1N1 hemagglutinin
gggagaaagcuuaccaugcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214488 - RNA, 1936 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214489 - RNA, 1930 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214490 - RNA, 1933 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214491 - RNA, 1948 nt, Artificial Sequence
  mRNA product opt Design1 from Influenza A H1N1 hemagglutinin
gggagaaagcuuaccaugggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214492 - RNA, 1924 nt, Artificial Sequence
  mRNA product opt Design1 from Influenza A H1N1 hemagglutinin
gggagaaagcuuaccauggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214493 - RNA, 1924 nt, Artificial Sequence
  mRNA product opt Design1 from Influenza A H1N1 hemagglutinin
gggagaaagcuuaccauggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214494 - RNA, 1924 nt, Artificial Sequence
  mRNA product opt Design1 from Influenza A H1N1 hemagglutinin
gggagaaagcuuaccauggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214495 - RNA, 1930 nt, Artificial Sequence
  mRNA product opt Design1 from Influenza A H1N1 hemagglutinin
gggagaaagcuuaccauggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214496 - RNA, 1945 nt, Artificial Sequence
  mRNA product opt Design1 from Influenza A H1N1 hemagglutinin
gggagaaagcuuaccaugaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214497 - RNA, 1930 nt, Artificial Sequence
  mRNA product opt Design1 from Influenza A H1N1 hemagglutinin
gggagaaagcuuaccaugggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214498 - RNA, 1927 nt, Artificial Sequence
  mRNA product opt Design1 from Influenza A H1N1 hemagglutinin
gggagaaagcuuaccauggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214499 - RNA, 1942 nt, Artificial Sequence
  mRNA product opt Design1 from Influenza A H1N1 hemagglutinin
gggagaaagcuuaccauggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214500 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214501 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214502 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugacccgccugaccgugcucgcccugcuggccggccuccuggcgagcucccgggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214503 - RNA, 2080 nt, Artificial Sequence
  mRNA product opt Design2 from Influenza A H1N1 hemagglutinin
ggggcgcugccuacggagguggcagccaucuccuucucggcaucaagcuuaccaugccccugcuccugcugcucccgcugcugugggccggcgcccucgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214504 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugaucaagcugaaguucggcguguucuucaccguccuccugagcuccgccuacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214505 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggccuuccuguggcuccugagcugcugggcccugcucggcaccaccuucggggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214506 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggagugaaaguucuuuuugcccuuauuuguauugcuguggccgaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214507 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggcgugaagguccuguucgcccucaucugcaucgccguggcggaggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214508 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214509 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214510 - RNA, 2092 nt, Artificial Sequence
  mRNA product opt Design2 from Influenza A H1N1 hemagglutinin
ggggcgcugccuacggagguggcagccaucuccuucucggcaucaagcuuaccauguaccggaugcagcugcucagcugcaucgcccugucgcuggcgcucgugaccaacagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214511 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugcgcgccuggaucuucuuccugcucugccuggccggccgggcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214512 - RNA, 2101 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214513 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214514 - RNA, 2098 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214515 - RNA, 2113 nt, Artificial Sequence
  mRNA product opt Design2 from Influenza A H1N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214516 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggaguucggccugagcuggguguuccucgucgcccuguuccgcggggugcagugcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214517 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggacuggaccuggcgcguguucugccugcucgccgucacccccggcgcccacccggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214518 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggccuggagcccccuguuccucacccugaucacccacugcgccggcuccugggcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214519 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggagaccgacacccugcuccugugggugcugcuccuguggguccccggcagcacgggggacgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214520 - RNA, 2110 nt, Artificial Sequence
  mRNA product opt Design2 from Influenza A H1N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214521 - RNA, 2095 nt, Artificial Sequence
  mRNA product opt Design2 from Influenza A H1N1 hemagglutinin
ggggcgcugccuacggagguggcagccaucuccuucucggcaucaagcuuaccaugggcaugcgcaugauguucaucauguucaugcuggugguccucgccaccaccguggugagcgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214522 - RNA, 2092 nt, Artificial Sequence
  mRNA product opt Design2 from Influenza A H1N1 hemagglutinin
ggggcgcugccuacggagguggcagccaucuccuucucggcaucaagcuuaccauggcccgcccccugugcacccuccugcugcucauggccacccuggcgggcgcccuggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214523 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214524 - protein, 567 aa, Artificial Sequence
  derived and/or modified sequence from Influenza A H1N1 hemagglutinin
MKWVTFISLLFLFSSAYSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214525 - protein, 567 aa, Artificial Sequence
  derived and/or modified sequence from Influenza A H1N1 hemagglutinin
MDWTWILFLVAAATRVHSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214526 - protein, 573 aa, Artificial Sequence
  derived and/or modified sequence from Influenza A H1N1 hemagglutinin
MPMGSLQPLATLYLLGMLVASCLGDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214527 - protein, 573 aa, Artificial Sequence
  derived and/or modified sequence from Influenza A H1N1 hemagglutinin
MAVMAPRTLVLLLSGALALTQTWADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214528 - protein, 574 aa, Artificial Sequence
  derived and/or modified sequence from Influenza A H1N1 hemagglutinin
MAVMAPRTLVLLLSGALALTQTWAGDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214529 - protein, 573 aa, Artificial Sequence
  derived and/or modified sequence from Influenza A H1N1 hemagglutinin
MASSLYSFLLALSIVYIFVAPTHSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214530 - protein, 568 aa, Artificial Sequence
  derived and/or modified sequence from Influenza A H1N1 hemagglutinin
MTRLTVLALLAGLLASSRADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214531 - protein, 565 aa, Artificial Sequence
  derived and/or modified sequence from Influenza A H1N1 hemagglutinin
MPLLLLLPLLWAGALADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214532 - protein, 568 aa, Artificial Sequence
  derived and/or modified sequence from Influenza A H1N1 hemagglutinin
MIKLKFGVFFTVLLSSAYADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214533 - protein, 567 aa, Artificial Sequence
  derived and/or modified sequence from Influenza A H1N1 hemagglutinin
MAFLWLLSCWALLGTTFGDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214534 - protein, 566 aa, Artificial Sequence
  derived and/or modified sequence from Influenza A H1N1 hemagglutinin
MGVKVLFALICIAVAEADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214535 - protein, 566 aa, Artificial Sequence; identical to SEQ ID NO: 214534
  derived and/or modified sequence from Influenza A H1N1 hemagglutinin

SEQ ID NO: 214536 - protein, 566 aa, Artificial Sequence; identical to SEQ ID NO: 2656
  derived and/or modified sequence from Influenza A H1N1 hemagglutinin

SEQ ID NO: 214537 - protein, 573 aa, Artificial Sequence
  derived and/or modified sequence from Influenza A H1N1 hemagglutinin
MALWMRLLPLLALLALWGPDPAAADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214538 - protein, 569 aa, Artificial Sequence
  derived and/or modified sequence from Influenza A H1N1 hemagglutinin
MYRMQLLSCIALSLALVTNSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214539 - protein, 566 aa, Artificial Sequence
  derived and/or modified sequence from Influenza A H1N1 hemagglutinin
MRAWIFFLLCLAGRALADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214540 - protein, 572 aa, Artificial Sequence
  derived and/or modified sequence from Influenza A H1N1 hemagglutinin
MDAMKRGLCCVLLLCGAVFVSPSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214541 - protein, 570 aa, Artificial Sequence
  derived and/or modified sequence from Influenza A H1N1 hemagglutinin
MDAMKRGLCCVLLLCGAVFVSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214542 - protein, 571 aa, Artificial Sequence
  derived and/or modified sequence from Influenza A H1N1 hemagglutinin
MDAMKRGLCCVLLLCGAVFVSPDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214543 - protein, 576 aa, Artificial Sequence
  derived and/or modified sequence from Influenza A H1N1 hemagglutinin
MGVHECPAWLWLLLSLLSLPLGLPVLGDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214544 - protein, 568 aa, Artificial Sequence
  derived and/or modified sequence from Influenza A H1N1 hemagglutinin
MEFGLSWVFLVALFRGVQCDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214545 - protein, 568 aa, Artificial Sequence
  derived and/or modified sequence from Influenza A H1N1 hemagglutinin
MDWTWRVFCLLAVTPGAHPDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214546 - protein, 568 aa, Artificial Sequence
  derived and/or modified sequence from Influenza A H1N1 hemagglutinin
MAWSPLFLTLITHCAGSWADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214547 - protein, 570 aa, Artificial Sequence
  derived and/or modified sequence from Influenza A H1N1 hemagglutinin
METDTLLLWVLLLWVPGSTGDDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214548 - protein, 575 aa, Artificial Sequence
  derived and/or modified sequence from Influenza A H1N1 hemagglutinin
MKTHYSSAILPILTLFVFLSINPSHGDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214549 - protein, 570 aa, Artificial Sequence
  derived and/or modified sequence from Influenza A H1N1 hemagglutinin
MGMRMMFIMFMLVVLATTVVSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214550 - protein, 569 aa, Artificial Sequence
  derived and/or modified sequence from Influenza A H1N1 hemagglutinin
MARPLCTLLLLMATLAGALADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214551 - protein, 574 aa, Artificial Sequence
  derived and/or modified sequence from Influenza A H1N1 hemagglutinin
MAISGVPVLGFFIIAVLMSAQESWADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 214552 - RNA, 1704 nt, Artificial Sequence
  derived and/or modified sequence opt from Influenza A H1N1 hemagglutinin
augaagugggugaccuucaucagccugcucuuccuguucuccagcgccuacuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214553 - RNA, 1704 nt, Artificial Sequence
  derived and/or modified sequence opt from Influenza A H1N1 hemagglutinin
auggacuggaccuggauccuguuccucguggccgccgcgacccgcguccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214554 - RNA, 1722 nt, Artificial Sequence
  derived and/or modified sequence opt from Influenza A H1N1 hemagglutinin
augcccaugggcagccugcagccgcucgccacccuguaccugcucgggaugcugguggccuccugccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214555 - RNA, 1722 nt, Artificial Sequence
  derived and/or modified sequence opt from Influenza A H1N1 hemagglutinin
auggccgugauggccccgcggacccugguccuccugcugagcggcgcgcucgcccugacccagacgugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214556 - RNA, 1725 nt, Artificial Sequence
  derived and/or modified sequence opt from Influenza A H1N1 hemagglutinin
auggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214557 - RNA, 1722 nt, Artificial Sequence
  derived and/or modified sequence opt from Influenza A H1N1 hemagglutinin
auggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214558 - RNA, 1707 nt, Artificial Sequence
  derived and/or modified sequence opt from Influenza A H1N1 hemagglutinin
augacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214559 - RNA, 1698 nt, Artificial Sequence
  derived and/or modified sequence opt from Influenza A H1N1 hemagglutinin
augccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214560 - RNA, 1707 nt, Artificial Sequence
  derived and/or modified sequence opt from Influenza A H1N1 hemagglutinin
augaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214561 - RNA, 1704 nt, Artificial Sequence
  derived and/or modified sequence opt from Influenza A H1N1 hemagglutinin
auggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214562 - RNA, 1701 nt, Artificial Sequence
  derived and/or modified sequence opt from Influenza A H1N1 hemagglutinin
augggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214563 - RNA, 1701 nt, Artificial Sequence
  derived and/or modified sequence opt from Influenza A H1N1 hemagglutinin
augggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214564 - RNA, 1701 nt, Artificial Sequence; identical to SEQ ID NO: 213534
  derived and/or modified sequence opt from Influenza A H1N1 hemagglutinin

SEQ ID NO: 214565 - RNA, 1722 nt, Artificial Sequence
  derived and/or modified sequence opt from Influenza A H1N1 hemagglutinin
auggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214566 - RNA, 1710 nt, Artificial Sequence
  derived and/or modified sequence opt from Influenza A H1N1 hemagglutinin
auguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214567 - RNA, 1701 nt, Artificial Sequence
  derived and/or modified sequence opt from Influenza A H1N1 hemagglutinin
augcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214568 - RNA, 1719 nt, Artificial Sequence
  derived and/or modified sequence opt from Influenza A H1N1 hemagglutinin
auggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214569 - RNA, 1713 nt, Artificial Sequence
  derived and/or modified sequence opt from Influenza A H1N1 hemagglutinin
auggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214570 - RNA, 1716 nt, Artificial Sequence
  derived and/or modified sequence opt from Influenza A H1N1 hemagglutinin
auggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214571 - RNA, 1731 nt, Artificial Sequence
  derived and/or modified sequence opt from Influenza A H1N1 hemagglutinin
augggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214572 - RNA, 1707 nt, Artificial Sequence
  derived and/or modified sequence opt from Influenza A H1N1 hemagglutinin
auggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214573 - RNA, 1707 nt, Artificial Sequence
  derived and/or modified sequence opt from Influenza A H1N1 hemagglutinin
auggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214574 - RNA, 1707 nt, Artificial Sequence
  derived and/or modified sequence opt from Influenza A H1N1 hemagglutinin
auggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214575 - RNA, 1713 nt, Artificial Sequence
  derived and/or modified sequence opt from Influenza A H1N1 hemagglutinin
auggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214576 - RNA, 1728 nt, Artificial Sequence
  derived and/or modified sequence opt from Influenza A H1N1 hemagglutinin
augaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214577 - RNA, 1713 nt, Artificial Sequence
  derived and/or modified sequence opt from Influenza A H1N1 hemagglutinin
augggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214578 - RNA, 1710 nt, Artificial Sequence
  derived and/or modified sequence opt from Influenza A H1N1 hemagglutinin
auggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214579 - RNA, 1725 nt, Artificial Sequence
  derived and/or modified sequence opt from Influenza A H1N1 hemagglutinin
auggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 214580 - RNA, 1942 nt, Artificial Sequence
  mRNA product opt Design1 from Influenza A H1N1 hemagglutinin
gggagaaagcuuaccauggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214581 - RNA, 1939 nt, Artificial Sequence
  mRNA product opt Design1 from Influenza A H1N1 hemagglutinin
gggagaaagcuuaccauggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214582 - RNA, 1924 nt, Artificial Sequence
  mRNA product opt Design1 from Influenza A H1N1 hemagglutinin
gggagaaagcuuaccaugacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214583 - RNA, 1915 nt, Artificial Sequence
  mRNA product opt Design1 from Influenza A H1N1 hemagglutinin
gggagaaagcuuaccaugccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214584 - RNA, 1924 nt, Artificial Sequence
  mRNA product opt Design1 from Influenza A H1N1 hemagglutinin
gggagaaagcuuaccaugaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214585 - RNA, 1921 nt, Artificial Sequence
  mRNA product opt Design1 from Influenza A H1N1 hemagglutinin
gggagaaagcuuaccauggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214586 - RNA, 1918 nt, Artificial Sequence
  mRNA product opt Design1 from Influenza A H1N1 hemagglutinin
gggagaaagcuuaccaugggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214587 - RNA, 1918 nt, Artificial Sequence
  mRNA product opt Design1 from Influenza A H1N1 hemagglutinin
gggagaaagcuuaccaugggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214588 - RNA, 1918 nt, Artificial Sequence; identical to SEQ ID NO: 213610
  mRNA product opt Design1 from Influenza A H1N1 hemagglutinin

SEQ ID NO: 214589 - RNA, 1939 nt, Artificial Sequence
  mRNA product opt Design1 from Influenza A H1N1 hemagglutinin
gggagaaagcuuaccauggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214590 - RNA, 1927 nt, Artificial Sequence
  mRNA product opt Design1 from Influenza A H1N1 hemagglutinin
gggagaaagcuuaccauguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214591 - RNA, 1918 nt, Artificial Sequence
  mRNA product opt Design1 from Influenza A H1N1 hemagglutinin
gggagaaagcuuaccaugcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214592 - RNA, 1936 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214593 - RNA, 1930 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214594 - RNA, 1933 nt, Artificial Sequence
  mRNA product opt Design1 from Influenza A H1N1 hemagglutinin
gggagaaagcuuaccauggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214595 - RNA, 1948 nt, Artificial Sequence
  mRNA product opt Design1 from Influenza A H1N1 hemagglutinin
gggagaaagcuuaccaugggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214596 - RNA, 1924 nt, Artificial Sequence
  mRNA product opt Design1 from Influenza A H1N1 hemagglutinin
gggagaaagcuuaccauggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214597 - RNA, 1924 nt, Artificial Sequence
  mRNA product opt Design1 from Influenza A H1N1 hemagglutinin
gggagaaagcuuaccauggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214598 - RNA, 1924 nt, Artificial Sequence
  mRNA product opt Design1 from Influenza A H1N1 hemagglutinin
gggagaaagcuuaccauggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214599 - RNA, 1930 nt, Artificial Sequence
  mRNA product opt Design1 from Influenza A H1N1 hemagglutinin
gggagaaagcuuaccauggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214600 - RNA, 1945 nt, Artificial Sequence
  mRNA product opt Design1 from Influenza A H1N1 hemagglutinin
gggagaaagcuuaccaugaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214601 - RNA, 1930 nt, Artificial Sequence
  mRNA product opt Design1 from Influenza A H1N1 hemagglutinin
gggagaaagcuuaccaugggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214602 - RNA, 1927 nt, Artificial Sequence
  mRNA product opt Design1 from Influenza A H1N1 hemagglutinin
gggagaaagcuuaccauggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
